US011203784B2

(12) United States Patent
Dor et al.

(10) Patent No.: US 11,203,784 B2
(45) Date of Patent: Dec. 21, 2021

(54) METHOD AND KIT FOR DETERMINING THE TISSUE OR CELL ORIGIN OF DNA

(71) Applicants: Yissum Research Development Company of the Hebrew University of Jerusalem Ltd., Jerusalem (IL); Hadasit Medical Research Services and Development Ltd., Jerusalem (IL)

(72) Inventors: Yuval Dor, Jerusalem (IL); Ruth Shemer, Mevasseret Zion (IL); Benjamin Glaser, Jerusalem (IL)

(73) Assignees: HADASIT MEDICAL RESEARCH SERVICES AND DEVELOPMENT LTD., Jerusalem (IL); YISSUM RESEARCH DEVELOPMENT COMPANY OF THE HEBREW UNIVERSITY OF JERUSALEM LTD., Jerusalem (IL)

( * ) Notice: Subject to any disclaimer, the term of this patent is extended or adjusted under 35 U.S.C. 154(b) by 0 days.

(21) Appl. No.: 15/303,762

(22) PCT Filed: Apr. 14, 2015

(86) PCT No.: PCT/IL2015/050403
§ 371 (c)(1),
(2) Date: Oct. 13, 2016

(87) PCT Pub. No.: WO2015/159292
PCT Pub. Date: Oct. 22, 2015

(65) Prior Publication Data
US 2017/0121767 A1  May 4, 2017

Related U.S. Application Data

(60) Provisional application No. 61/979,233, filed on Apr. 14, 2014.

(51) Int. Cl.
| C07H 21/04 | (2006.01) |
| C12Q 1/68 | (2018.01) |
| C12Q 1/6881 | (2018.01) |
| C12Q 1/6886 | (2018.01) |
| C12Q 1/6883 | (2018.01) |

(52) U.S. Cl.
CPC ......... *C12Q 1/6881* (2013.01); *C12Q 1/6883* (2013.01); *C12Q 1/6886* (2013.01); *C12Q 2600/154* (2013.01)

(58) Field of Classification Search
None
See application file for complete search history.

(56) References Cited

U.S. PATENT DOCUMENTS

| 2013/0295567 A1 | 11/2013 | Link et al. |
| 2014/0256574 A1* | 9/2014 | Herold ................. C12Q 1/6883 |
| | | 506/9 |
| 2014/0287404 A1 | 9/2014 | Huang et al. |

FOREIGN PATENT DOCUMENTS

| EP | 1342794 | 9/2003 |
| WO | WO 99/18124 | 4/1999 |
| WO | WO 2005/118852 | 12/2005 |
| WO | WO 2008/149237 | 12/2008 |
| WO | WO 2011/001728 | 1/2011 |
| WO | WO 2011/101728 | 8/2011 |
| WO | WO 2012/047091 | 4/2012 |
| WO | WO 2012/178007 | 12/2012 |
| WO | WO 2013/131083 | 9/2013 |
| WO | WO 2014/013813 | 1/2014 |
| WO | WO 2014/138133 | 9/2014 |
| WO | WO 2015/159292 | 10/2015 |
| WO | WO 2015/159293 | 10/2015 |
| WO | WO 2015/169947 | 11/2015 |
| WO | WO 2017/011390 | 1/2017 |
| WO | WO 2019/012542 | 1/2019 |
| WO | WO 2019/012543 | 1/2019 |
| WO | WO 2019/012544 | 1/2019 |

OTHER PUBLICATIONS

Husseiny et al. (PLOS One, vol. 7, No. 10, e47942, Oct. 2012). (Year: 2012).*
Husseiny et al. (PLOS One, vol. 9, No. 4, e94591, Apr. 2014). (Year: 2014).*
Madi et al. (Electrophoresis, vol. 33, pp. 1736-1745, 2012). (Year: 2012).*
Radpour et al. (PLOS vol. 6, No. 1, pp. e16080, Jan. 2011). (Year: 2011).*
Kadam et al. (J. of Molecular Diagnostics, vol. 14, No. 4, pp. 346-355, Jul. 2012 (Year: 2012).*
Volkmar et al. (EMBO Journal, vol. 31, pp. 1405-1426, 2012) (Year: 2012).*
Warton et al. (BMC Genomics, vol. 15, No. 476, pp. 1-13, Jun. 15, 2014). (Year: 2014).*
Zhang et al. (Genes, vol. 1, pp. 85-101, 2010). (Year: 2010).*

(Continued)

*Primary Examiner* — Jeanine A Goldberg
(74) *Attorney, Agent, or Firm* — Browdy and Neimark, PLLC

(57) ABSTRACT

A method of detecting death of a cell type or tissue in a subject is disclosed. The method comprises determining whether cell-free DNA comprised in a fluid sample of the subject is derived from the cell type or tissue, wherein the determining is effected by ascertaining the methylation status of at least four methylation sites on a continuous sequence of the cell-free DNA, the sequence comprising no more than 300 nucleotides, wherein a methylation status of each of the at least four methylation sites on the continuous sequence of the DNA characteristic of the cell type or tissue is indicative of death of the cell type or tissue. Kits for detecting cell death are also disclosed.

32 Claims, 45 Drawing Sheets
(28 of 45 Drawing Sheet(s) Filed in Color)

Specification includes a Sequence Listing.

(56) References Cited

OTHER PUBLICATIONS

Varley et al. (Genome Research, vol. 20, pp. 1279-1287, 2010) (Year: 2010).*
Sun et al. (Frontiers in Genetics, vol. 5, Article 150, Jun. 3, 2014). (Year: 2014).*
Communication Relating to the Results of the Partial International Search dated Aug. 6, 2015 From the International Searching Authority Re. Application No. PCT/IL2015/050403.
Communication Relating to the Results of the Partial International Search dated Aug. 6, 2015 From the International Searching Authority Re. Application No. PCT/IL2015/050404.
International Preliminary Report on Patentability dated Oct. 27, 2016 From the International Bureau of WIPO Re. Application No. PCT/IL2015/050403.
International Preliminary Report on Patentability dated Oct. 27, 2016 From the International Bureau of WIPO Re. Application No. PCT/IL2015/050404.
International Search Report and the Written Opinion dated Oct. 14, 2015 From the International Searching Authority Re. Application No. PCT/IL2015/050403.
International Search Report and the Written Opinion dated Oct. 14, 2015 From the International Searching Authority Re. Application No. PCT/IL2015/050404.
Avraham et al. "Table S4. TRIM29 CpG Island Genomic Sequence, Illumina Probes Details and Primers for Q-MSP and RT-PCR", PLOS ONE, XP002741464, 9(3), Mar. 20, 2014.
Avraham et al. "Tissue Specific DNA Methylation in Normal Human Breast Epithelium and in Breast Cancer", PLOS ONE XP055197434, 9(3): e91805-1-e91805-8, Mar. 20, 2014. Abstract, p. 2, col. 2, Last Para-p. 3, col. 2, Para 1, Table S4.
Epicentre "EpiGnome™ Methyl-Sq Kit. EpiGnome™ Index PCR Primers", Epicentre, XP055198537, p. 1-10, Aug. 1, 2013.
Husseiny et al. "Development of A Quantitative Methylation-Specific Polymerase Chain Reaction Method for Monitoring Beta Cell Death Type 1 Diabetes", PLOS ONE, XP055131207, 7(10): e47942-1-e47942-11, Oct. 29, 2012. Abstract, Table 1, Fig.1, p. 3, col. 1, Last Para-col. 2, Para 1, Section 'Detection of Circulating Beta Cell-Specific DNA by qMSP in Mouse Blood', p. 6, p. 8, col. 2, Para 2.
Husseiny et al. "Table S1. Oligonucleotides Used in This Study", PLOS ONE, XP002741463, 9(4): I, Apr. 10, 2014.
Husseiny et al. "Tissue-Specific Methylation of Human Insulin Gene and PCR Assay for Monitoring Beta Cell Death", PLOS ONE, XP055197433, 9(4): e94591-1-e94591-9, Apr. 10, 2014. Abstract, Results, Fig.4, p. 2, col. 2, Para 2.
Lebastchi et al. "Immune Therapy and Beta-Cell Death in Type 1 Diabetes", Diabetes, XP055197604, 62(5): 1676-1680, Published Online Feb. 19, 2013. Abstract, Fig.1, Research Design and Methods.
Madi et al. "The Determination of Tissue-Specific DNA Methylation Patterns in Forensic Biofluids Using Bisulfite Modification and Pyrosequencing", Electrophoresis, XP055197910, 33(12): 1736-1745, Jun. 28, 2012. Abstract, Tables 1, 3, 5, Materials and Methods, Sections 2.2, 2.4, 2.5, Discussion.
McClosky et al. "Encoding PCR Products With Batch-Stamps and Barcodes", Biochemical Genetics, XP019548696, 45(11-12): 761-767, Published Online Oct. 23, 2007. Abstract.
Rakyan et al. "Epigenome-Wide Association Studies for Common Human Diseases", Nature Reviews Genetics, XP055197423, 12(8): 529-541, Published Online Jul. 12, 2011.
Rieke et al. "Homo Sapiens Chromosome 16, Cosmid Clone 400H11 (LANL), Complete Sequence", Database EMBL [Online], XP002741448, Retrieved From EBI Accession No. EM_STD:AC004495, Database Accession No. AC004495, Apr. 6, 1998. Sequence.
Bidshahri et al. "Quantitative Detection and Resolution of BRAF V600 Status in Colorectal Cancer Using Droplet Digital PCR and A Novel Wild-Type Negative Assay", The Journal of Molecular Diagnostics, 18(2): 190-204, Mar. 2016.
Usmani-Brown et al. "Analysis of Beta-Cell Death in Type 1 Diabetes by Droplet Digital PCR", Endocrinology, 155(9): 3694-3698, Published Online Jul. 8, 2014.
Communication Under Rule 164(2)(a) EPC dated Feb. 16, 2018 From the European Patent Office Re. Application No. 15720481.9. (3 Pages).
Communication Pursuant to Article 94(3) EPC dated Aug. 3, 2018 From the European Patent Office Re. Application No. 15720481.9. (4 Pages).
International Search Report and the Written Opinion dated Oct. 17, 2018 From the International Searching Authority Re. Application No. PCT/IL2018/050772. (17 Pages).
Hayashi et al. "PAX5 Methylation Detection by Droplet Digital PCR for Ultra-Sensitive Deep Surgical Margins Analysis of Head and Neck Squamous Cell Carcinoma", Cancer Prevention Research, XP055391790, 8(11): 1017-1026, Published Online Aug. 24, 2015.
Hernandez et al. "Optimizing Methodologies for PCR-Based DNA Methylation Analysis", Biotechniques Rapid Dispatches, XP055513098, 55(4): 181-197, Oct. 2013.
Lehmann-Werman et al. "Monitoring Liver Damage Using Hepatocyte-Specific Methylation Markers in Cell-Free Circulating DNA", JCI Insight, XP055511731, 3(12): e120687-1-e120687-10, Published Online Jun. 21, 2018.
Liu et al. "Methylation-Sensitive Enrichment of Minor DNA Alleles Using A Double-Strand DNA-Specific Nuclease", Nucleic Acids Research, XP055512982, 45(6): e39-1-e39-11, Published Online Nov. 28, 2016. Abstract, Figs. 1-4, p. 4-6, p. 9, Figs.S1, S7, Tables S2, S4.
Olkov-Mitsel et al. "Novel Multiplex MethyLight Protocol for Detection of DNA Methylation in Patient Tissues and Bodily Fluids", Scientific Reports, XP055143311, 4: 4432-1-4432-8, Published Online Mar. 21, 2014.
Redshaw et al. "Quantification of Epigenetic Biomarkers: An Evaluation of Established and Emerging Methods for DNA Methylation Analysis", BMC Genomics, XP021211806, 15(1): 1174-1-1174-14, Dec. 23, 2014.
Yu et al. "MethyLight Droplet Digital PCR for Detection and Absolute Quantification of Infrequently Methylated Alleles", Epigenetics, XP055512682, 10(9): 803-809, Published Online Jul. 17, 2015.
Zemmour et al. "Non-Invasive Detection of Human Cardiomyocyte Death Using Methylation Patterns of Circulating DNA", Nature Communications, XP055513857, 9(1): 1443-1-1443-10, Apr. 24, 2018.
International Search Report and the Written Opinion dated Nov. 28, 2018 From the International Searching Authority Re. Application No. PCT/IL2018/050771. (21 Pages).
International Search Report and the Written Opinion dated Oct. 12, 2018 From the International Searching Authority Re. Application No. PCT/IL2018/050770. (16 Pages).
Invitation to Pay Additional Fees, Communication Relating to the Results of the Partial International Search and the Provisional Opinion dated Oct. 5, 2018 From the International Searching Authority Re. Application No. PCT/IL2018/050771. (23 Pages).
Hodges et al. "High Definition Profiling of Mammalian DNA Methylation by Array Capture and Single Molecule Bisulfate Sequencing", Genome Research, XP002658586, 19(9): 1593-1605, Sep. 2009. Abstract, Figs.1, 2, p. 1595, col. 2, Para 2-3, p. 1596, col. 2, Para 3-p. 1597, col. 2, Para 1.
Lehmann-Werman et al. "Identification of Tissue-Specific Cell Death Using Methylation Patterns of Circulating DNA", Proc. Natl. Acad. Sci. USA, PNAS, XP055436315, 113(13): E1826-E1834, Published Online Mar. 14, 2018.
Masser et al. "Bilsufite Oligonucleotide-Capture Sequencing for Targeted Base-and Strand-Specific Absolute 5-Methylcytosine Quantitation", AGE, XP035993471, 38(3): 49-1-49-14, Published Online Apr. 18, 2016.
Mattox et al. "Bisulfite-Converted Duplexes for the Strand-Specific Detection and Quantification of Rare Mutations", Proc. Natl. Acad. Sci. USA, PNAS, XP055511259, 114(18): 4733-4738, May 2, 2017. Abstract, Fig.1, p. 4737, col. 1, Paras 2-3.

(56) References Cited

OTHER PUBLICATIONS

Qiagen "Epigenetics Sample and Assay Technologies", Internet Citation, XP002691674, Product Guide, Chap.4: 156-167, Nov. 2010. Item 4.2.

Zhong et al. "The Role of DNA Methylation in Cardiovascular Risk and Disease: Methodological Aspects, Study Design, and Data Analysis for Epidemiological Studies", Circulation Research, XP055511928, 118(1): 119-131, Jan. 8, 2016. Abstract, p. 3.

Notice of Reasons for Rejection dated Feb. 12, 2019 From the Japan Patent Office Re. Application No. 2016-562026 and Its Translation Into English. (14 Pages).

Summons to Attend Oral Proceedings Pursuant to Rule 115(1) EPC Dated May 2, 2019 From the European Patent Office Re. Application No. 15720481.9. (8 Pages).

Gene Specific DNA methylation, downloaded from https://www.epigendx.com/d/service/pyrosequencing/dna-methylation on Feb. 17, 2020.

Coverage (genetics), downloaded from https://en/wikipedia.org/w/index.php?title=Coverage_(genetics)&oldid=934959158 on Feb. 17, 2020.

\* cited by examiner

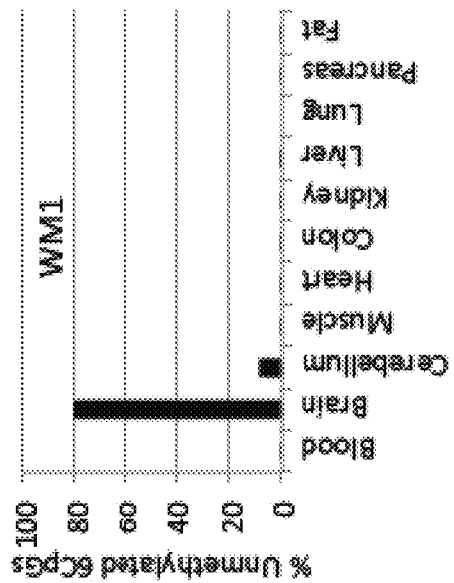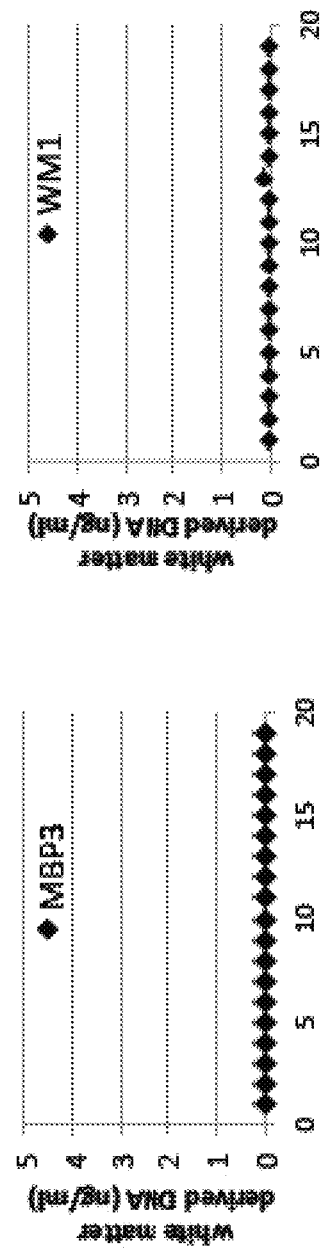
FIG. 2A
FIG. 2B

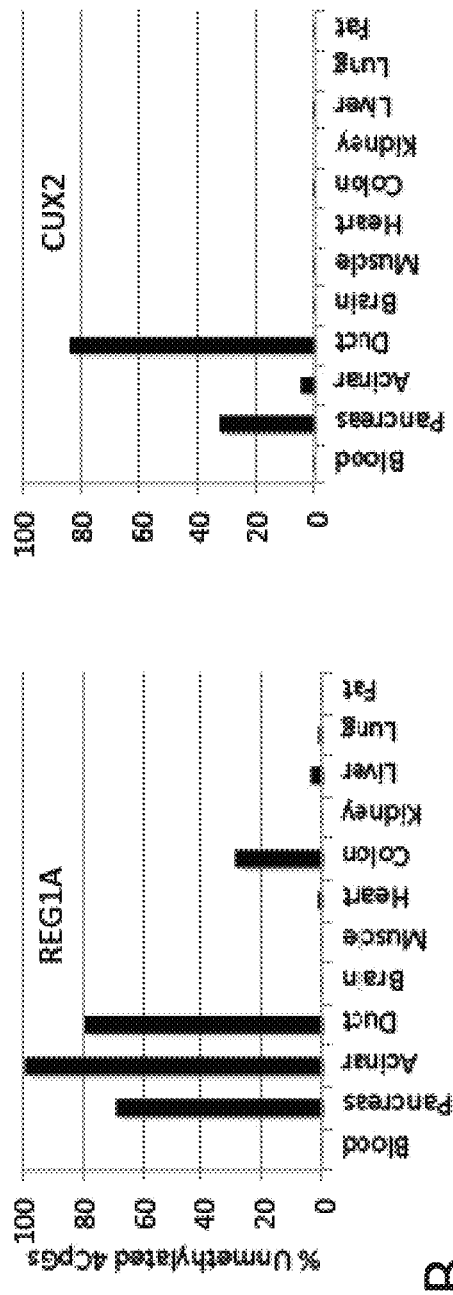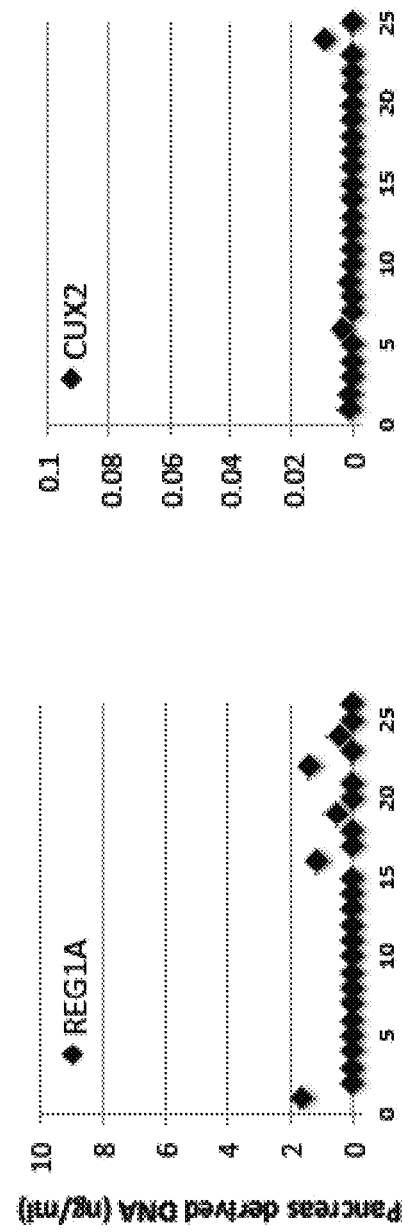
FIG. 4A
FIG. 4B

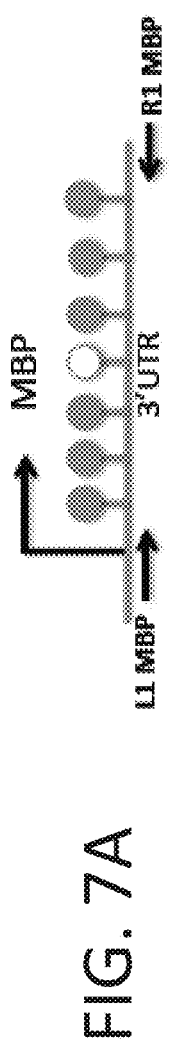
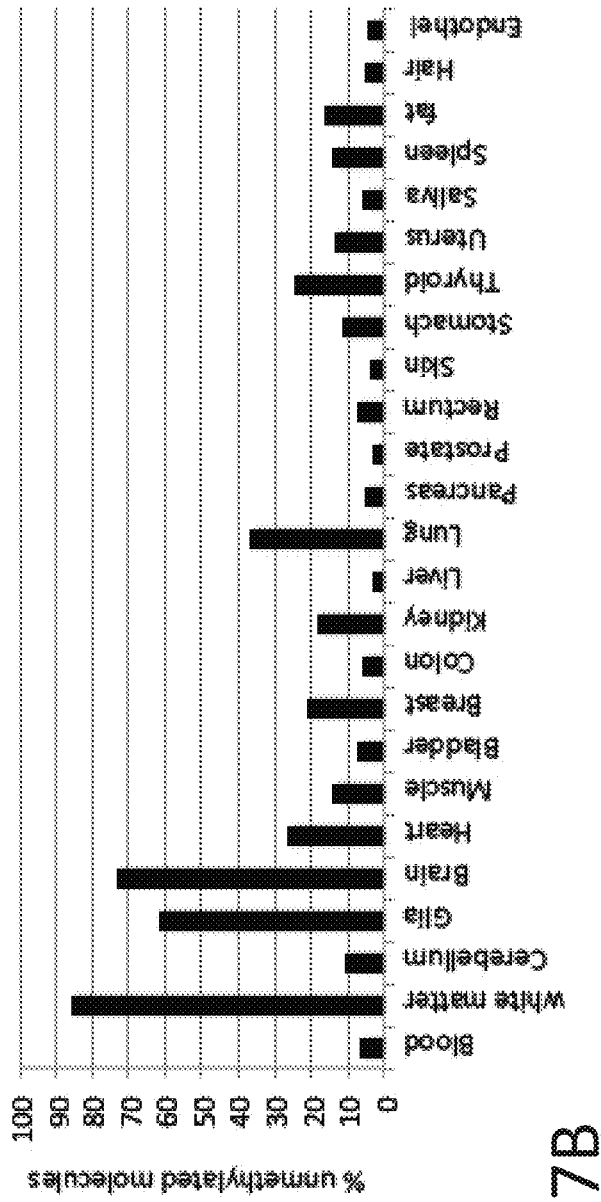
FIG. 7A
FIG. 7B

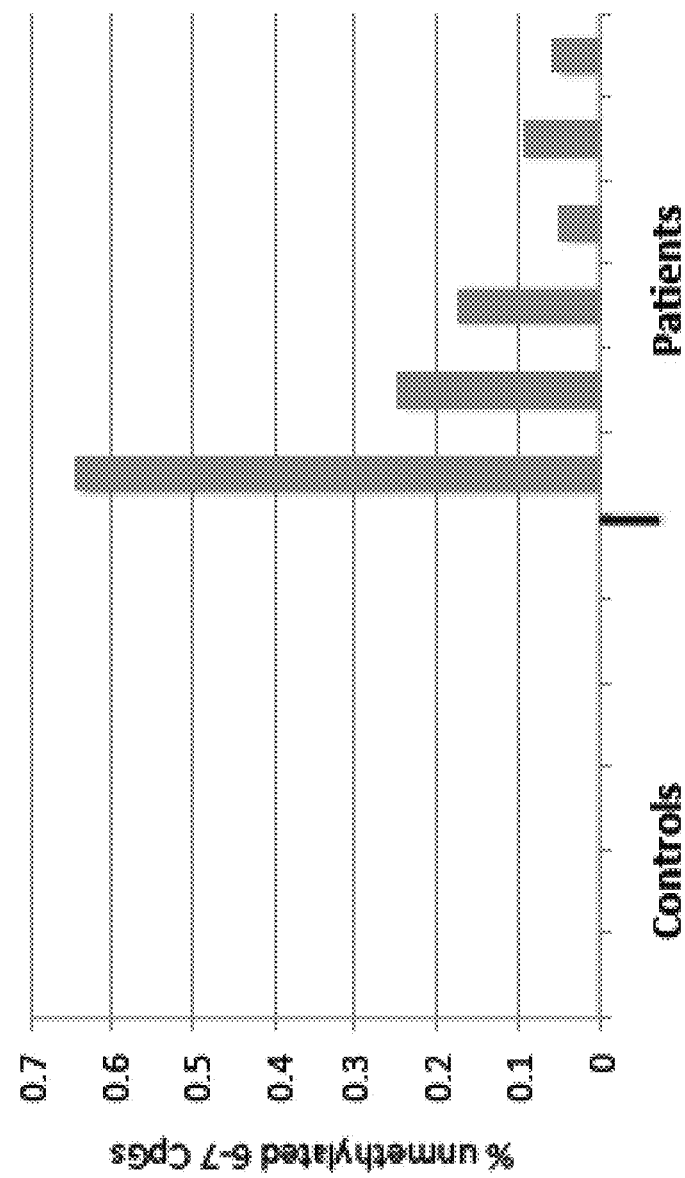

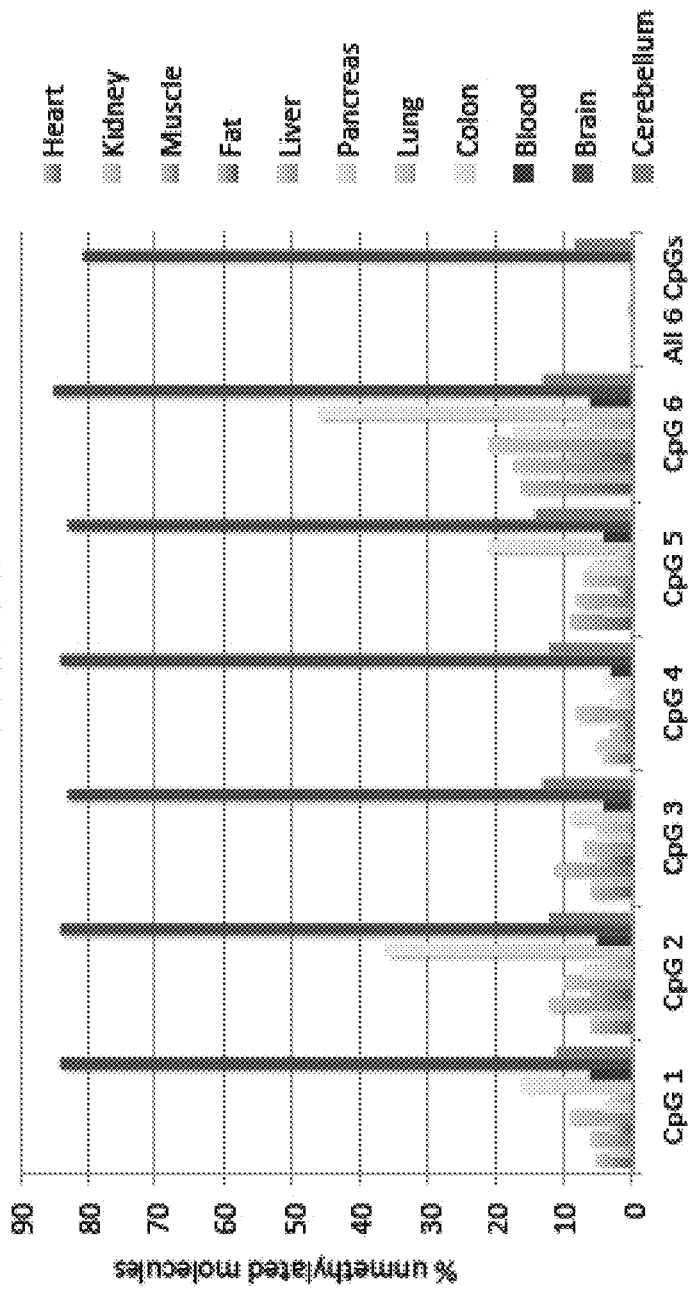

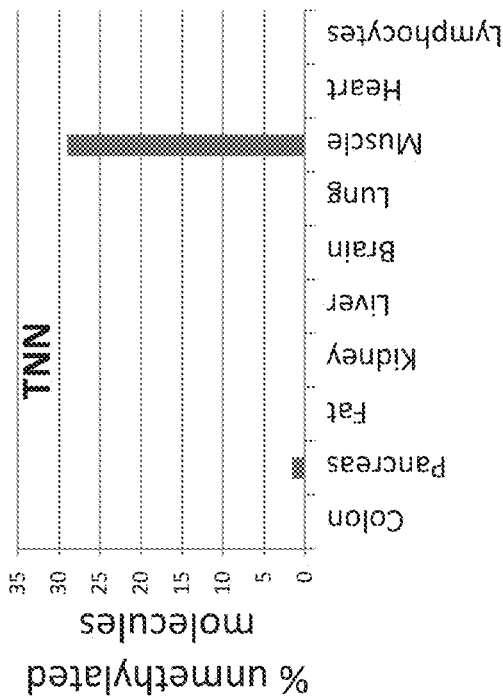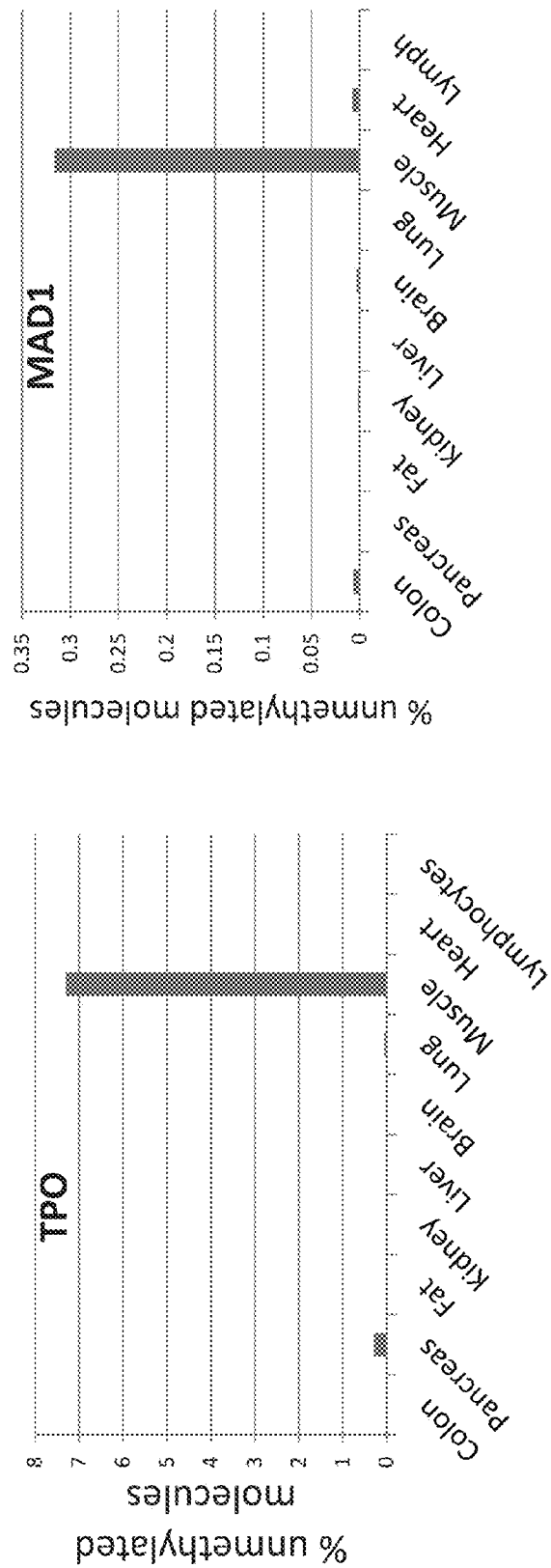
FIG. 20A  FIG. 20B  FIG. 20C

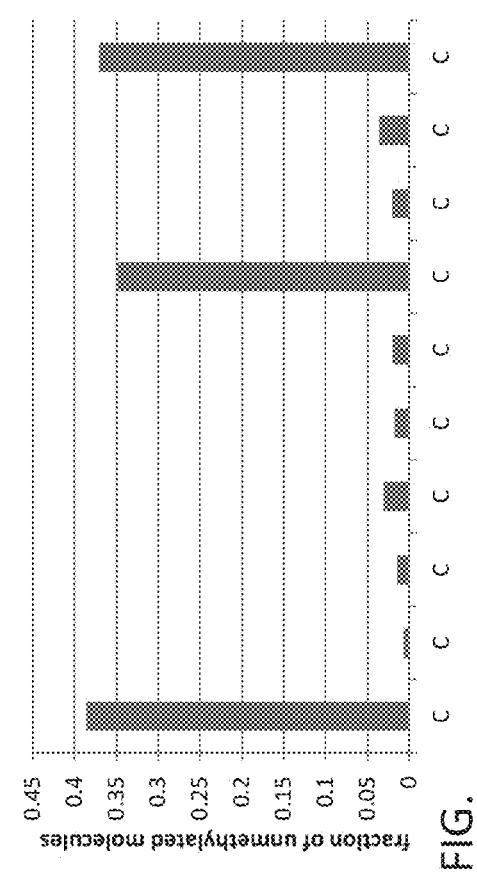
FIG. 27A ACOT7 - Fat marker serum samples
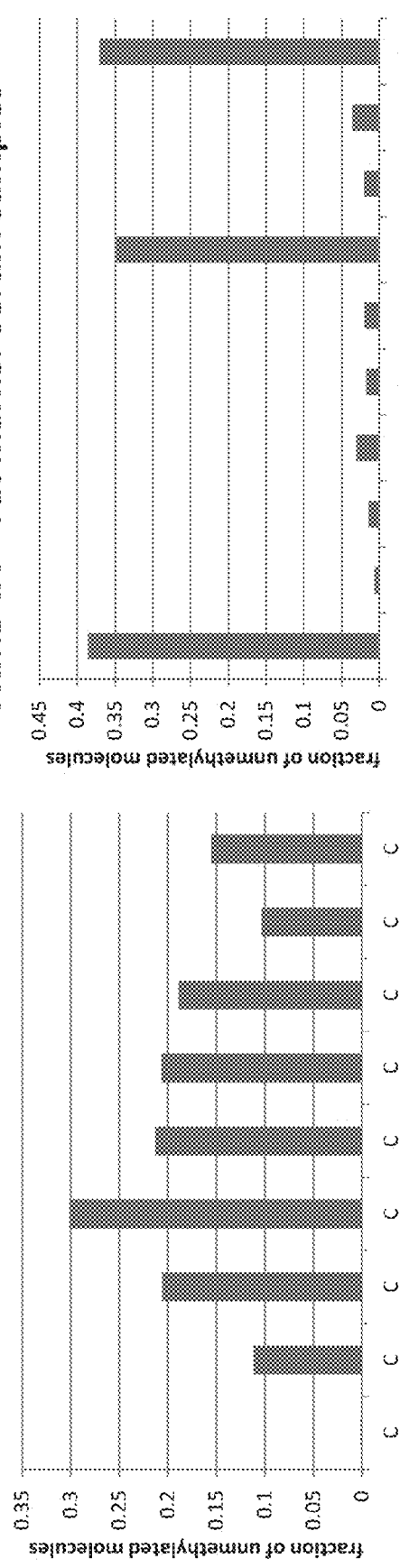
FIG. 27B FRMD4A - Fat marker serum samples
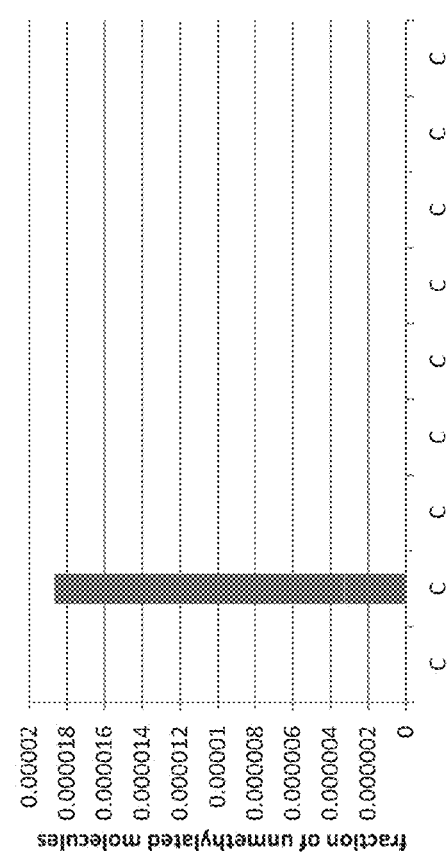
FIG. 27C COL4A1 - Fat marker serum samples
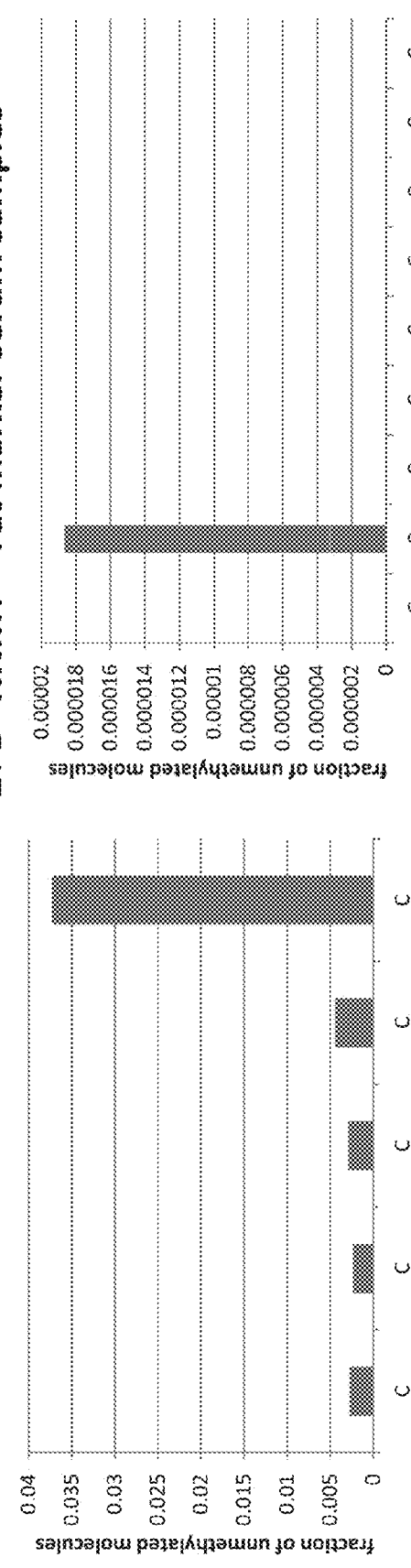
FIG. 27D NNMT - Fat marker serum samples

METHOD AND KIT FOR DETERMINING THE TISSUE OR CELL ORIGIN OF DNA

RELATED APPLICATIONS

This application is a National Phase of PCT Patent Application No. PCT/IL2015/050403 having International filing date of Apr. 14, 2015, which claims the benefit of priority under 35 USC § 119(e) of U.S. Provisional Patent Application No. 61/979,233 filed on Apr. 14, 2014. The contents of the above applications are all incorporated by reference as if fully set forth herein in their entirety.

SEQUENCE LISTING STATEMENT

The ASCII file, entitled 67714SequenceListing.txt, created on Oct. 13, 2016, comprising 1,153,982 bytes, submitted concurrently with the filing of this application is incorporated herein by reference.

FIELD AND BACKGROUND OF THE INVENTION

The present invention, in some embodiments thereof, relates to a method of determining the source of cell-free DNA and use thereof for diagnosing pathological processes associated with cell death, monitoring therapeutic regimes such as drugs intended to change cell death and in studying for clinical and research purposes processes affecting cell death levels.

It has been known for decades that plasma contains small fragments of cell-free circulating DNA (cfDNA) derived from dead cells (on average 5000 genome equivalents per ml). While the mechanisms underlying the release and clearance of cfDNA remain obscure, the phenomenon is rapidly being exploited for a variety of applications with clinical relevance. The recognition that fragments of fetal DNA travel briefly in maternal circulation has opened the way for next generation sequencing (NGS)-based prenatal testing to identify fetal trisomies and other genetic aberrations, potentially replacing amniocentesis. In cancer biology, tumors are known to release DNA (including tumor-specific somatic mutations) into the circulation, providing means for liquid biopsies to monitor tumor dynamics and genomic evolution. In addition, cfDNA has been used to detect graft cell death after kidney, liver or heart transplantation, based on single nucleotide polymorphisms (SNPs) distinguishing the DNA of donor from that of recipients. In all these cases, genetic differences exist between the DNA sequence of the tissue of interest (fetus, tumor or graft) and that of the host, providing the basis for highly specific assays.

Blood levels of cfDNA are known to increase under multiple additional conditions such as traumatic brain injury, cardiovascular disease, sepsis and intensive exercise. However in these cases, the source of elevated cfDNA is unknown, greatly compromising the utility of cfDNA as a diagnostic or prognostic tool. For example, cfDNA could originate from parenchymal cells of the injured tissue, but also from dying inflammatory cells.

Despite having an identical nucleotide sequence, the DNA of each cell type in the body carries unique epigenetic marks correlating with its gene expression profile. In particular, DNA methylation, serving to repress nontranscribed genes, is a fundamental aspect of tissue identity. Methylation patterns are unique to each cell type, conserved among cells of the same type in the same individual and between individuals, and are highly stable under physiologic or pathologic conditions. Therefore, it may be possible to use the DNA methylation pattern of cfDNA to determine its tissue of origin and hence to infer cell death in the source organ.

Theoretically, such an approach could identify the rate of cell death in a tissue of interest, taking into account the total amount of cfDNA, the fraction derived from a tissue of interest, and the estimated half life of cfDNA (15-120 minutes). Note that since the approach relies on normal, stable markers of cell identity, it cannot identify the nature of the pathology (e.g. distinguishing cfDNA derived from dead tumor cells or dead wild type cells due to trauma or inflammation in the same tissue). The potential uses of a highly sensitive, minimally invasive assay of tissue specific cell death include early, precise diagnosis as well as monitoring response to therapy in both a clinical and drug-development setting.

A classic example of tissue-specific DNA methylation is provided by the insulin gene promoter, which is unmethylated in insulin-producing pancreatic β-cells and methylated elsewhere. Recent studies have identified unmethylated insulin promoter DNA in the circulation of newly diagnosed T1D patients as well as in islet graft recipients, likely reflecting both autoimmune and alloimmune destruction of β-cells (Akirav E. M. et al. Proceedings of the National Academy of Sciences of the United States of America, 108, 19018-19023 (2011); Lebastchi J et al., Diabetes 62, 1676-1680 (2013); Husseiny M. I. Plos one 9 e94591 (2014; and Herold K. C. et al., J Clin Invest. Doi:10.1172/jc178142 (2015)).

Additional background art includes International PCT Publication No. WO2013131083, WO 2014138133 and WO201101728.

SUMMARY OF THE INVENTION

According to an aspect of some embodiments of the present invention there is provided a method of detecting death of a cell type or tissue in a subject comprising determining whether cell-free DNA comprised in a fluid sample of the subject is derived from the cell type or tissue, wherein the determining is effected by ascertaining the methylation status of at least four methylation sites on a continuous sequence of the cell-free DNA, the sequence comprising no more than 300 nucleotides, wherein a methylation status of each of the at least four methylation sites on the continuous sequence of the DNA characteristic of the cell type or tissue is indicative of death of the cell type or tissue.

According to an aspect of some embodiments of the present invention there is provided a method of identifying a methylation signature for a cell type or tissue of interest comprising identifying in the DNA of the cell type of interest a continuous sequence of no more than 300 nucleotides which comprise at least 4 methylation sites, wherein each of the sites are differentially methylated with respect to a second non-identical cell type or tissue, thereby identifying the methylation signature for the cell type or tissue of interest.

According to an aspect of some embodiments of the present invention there is provided a method of determining whether DNA is derived from a cell type or tissue of interest in a sample, the method comprising:

ascertaining the methylation status of at least four methylation sites on a continuous sequence of the DNA, the sequence comprising no more than 300 nucleotides, wherein a methylation status of each of the at least four methylation sites on the continuous sequence characteristic of the cell of interest, is indicative that the DNA is derived from the cell of interest.

According to an aspect of some embodiments of the present invention there is provided a kit for identifying the source of DNA in a sample comprising oligonucleotides which are capable of detecting the methylation status of at least four methylation sites in a nucleic acid sequence, the nucleic acid sequence being no longer than 300 base pairs and comprising at least four methylation sites which are differentially methylated in a first cell of interest with respect to a second cell which is non-identical to the first cell of interest.

According to an aspect of some embodiments of the present invention there is provided a kit for identifying the source of DNA in a sample comprising at least two oligonucleotides which are capable of amplifying a DNA having a nucleic acid sequence no longer than 300 base pairs, wherein the nucleic acid sequence comprises at least four methylation sites which are differentially methylated in a first cell of interest with respect to a second cell which is non-identical to the first cell of interest.

According to some embodiments of the invention, the methylation status is characteristic of a non-diseased cell type or tissue of interest.

According to some embodiments of the invention, the sequence comprises between 50-250 nucleotides.

According to some embodiments of the invention, when death of the cell type is associated with a pathological process, the method further comprises diagnosing the pathological process.

According to some embodiments of the invention, the DNA is cell-free DNA.

According to some embodiments of the invention, the DNA is cellular DNA.

According to some embodiments of the invention, the method further comprises lysing the cells of the cellular DNA prior to the determining.

According to some embodiments of the invention, the at least four methylation sites comprises at least five methylation sites.

According to some embodiments of the invention, the cell type of interest is comprised in a body fluid.

According to some embodiments of the invention, the sample comprises a body fluid.

According to some embodiments of the invention, the fluid is selected from the group consisting of blood, plasma, sperm, milk, urine, saliva and cerebral spinal fluid.

According to some embodiments of the invention, the ascertaining is effected using at least one methylation-dependent oligonucleotide.

According to some embodiments of the invention, the methylation-dependent oligonucleotide hybridizes to at least one of the four methylation sites, the site being methylated.

According to some embodiments of the invention, the methylation-dependent oligonucleotide hybridizes to at least one of the four methylation sites, the site being non-methylated.

According to some embodiments of the invention, the ascertaining is effected using a methylation-independent oligonucleotide.

According to some embodiments of the invention, the ascertaining is effected using at least two methylation-independent oligonucleotides.

According to some embodiments of the invention, the ascertaining is effected by:

(a) contacting the DNA in the sample with bisulfite to convert demethylated cytosines of the DNA to uracils;

(b) amplifying the continuous sequence of DNA using oligonucleotides that hybridize to a nucleic acid sequence adjacent to the first and last of the at least four methylation sites on the continuous sequence of the DNA; and (c) sequencing the continuous sequence of DNA.

According to some embodiments of the invention, the sample comprises cell-free DNA which is derived from a second cell which is non-identical to the cell type or tissue.

According to some embodiments of the invention, the method further comprises analyzing the amount of cell-free DNA derived from the cell type or tissue: amount of cell-free DNA derived from the second cell.

According to some embodiments of the invention, the method further comprises analyzing the amount of cell-free DNA derived from the cell type or tissue: total amount of cell-free DNA in the sample.

According to some embodiments of the invention, the cell type is selected from the group consisting of a pancreatic beta cell, a pancreatic exocrine cell, a hepatocyte, a brain cell, a lung cell, a uterus cell, a kidney cell, a breast cell, an adipocyte, a colon cell, a rectum cell, a cardiomyocyte, a skeletal muscle cell, a prostate cell and a thyroid cell.

According to some embodiments of the invention, the tissue is selected from the group consisting of pancreatic tissue, liver tissue, lung tissue, brain tissue, uterus tissue, renal tissue, breast tissue, fat, colon tissue, rectum tissue, heart tissue, skeletal muscle tissue, prostate tissue and thyroid tissue.

According to some embodiments of the invention, the sample is a blood sample.

According to some embodiments of the invention, the method further comprises quantitating the amount of cell-free DNA which is derived from the cell type or tissue.

According to some embodiments of the invention, the sequence comprises between 50-250 nucleotides.

According to some embodiments of the invention, the DNA is cell-free DNA.

According to some embodiments of the invention, the DNA sequence is comprised in a sequence set forth in any one of SEQ ID NOs: 1-1484.

According to some embodiments of the invention, the kit further comprises at least one agent for sequencing the DNA sequence.

According to some embodiments of the invention, the kit further comprises DNA having the nucleic acid sequence, wherein the DNA is derived from a known cell of interest.

According to some embodiments of the invention, the kit is for diagnosing a pathological process.

According to some embodiments of the invention, the kit is for monitoring a treatment for a pathological process.

According to some embodiments of the invention, the kit is for monitoring death of a cell type or tissue.

According to some embodiments of the invention, the kit further comprises bisulfite.

According to some embodiments of the invention, at least one of the at least two oligonucleotides encodes a bar-code sequence.

According to some embodiments of the invention, at least one of the at least two oligonucleotides is labeled with an identifiable moiety.

According to some embodiments of the invention, the at least one oligonucleotide is labeled with a detectable moiety.

According to some embodiments of the invention, at least one of the at least two oligonucleotides encodes a bar-code sequence.

According to some embodiments of the invention, the two oligonucleotides encode sequences which allow for attaching to a flow cell surface.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE SEVERAL VIEWS OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings and images. With specific reference now to the drawings in detail, it is stressed that the particulars shown are by way of example and for purposes of illustrative discussion of embodiments of the invention. In this regard, the description taken with the drawings makes apparent to those skilled in the art how embodiments of the invention may be practiced.

In the drawings:

FIGS. 1A-D: beta cell-derived DNA in the circulation of T1D diabetes patients.

A, structure of the insulin gene promoter fragment used as marker. Black dots represent CpG sites, arrows mark positions of PCR primers.

B, methylation status of individual CpG sites in the insulin gene promoter in multiple tissues. Graph shows the percentage of unmethylated molecules in DNA from each tissue. The set of columns on the right describe the percentage of molecules in which all 6 CpG sites are unmethylated.

C, beta-cell derived DNA in the plasma of healthy controls (c) and recently diagnosed T1D patients. The fraction of fully unmethylated insulin promoter DNA molecules (reflective of the fraction of beta-cell derived DNA) was multiplied by the absolute level of cfDNA measured in each individual. Mann Whitney test for controls vs patients, p<0.0001.

D, beta-cell derived DNA in the circulation of long-time T1D patients sampled at the indicated time points after intrahepatic islet transplantation.

Figure 2C:
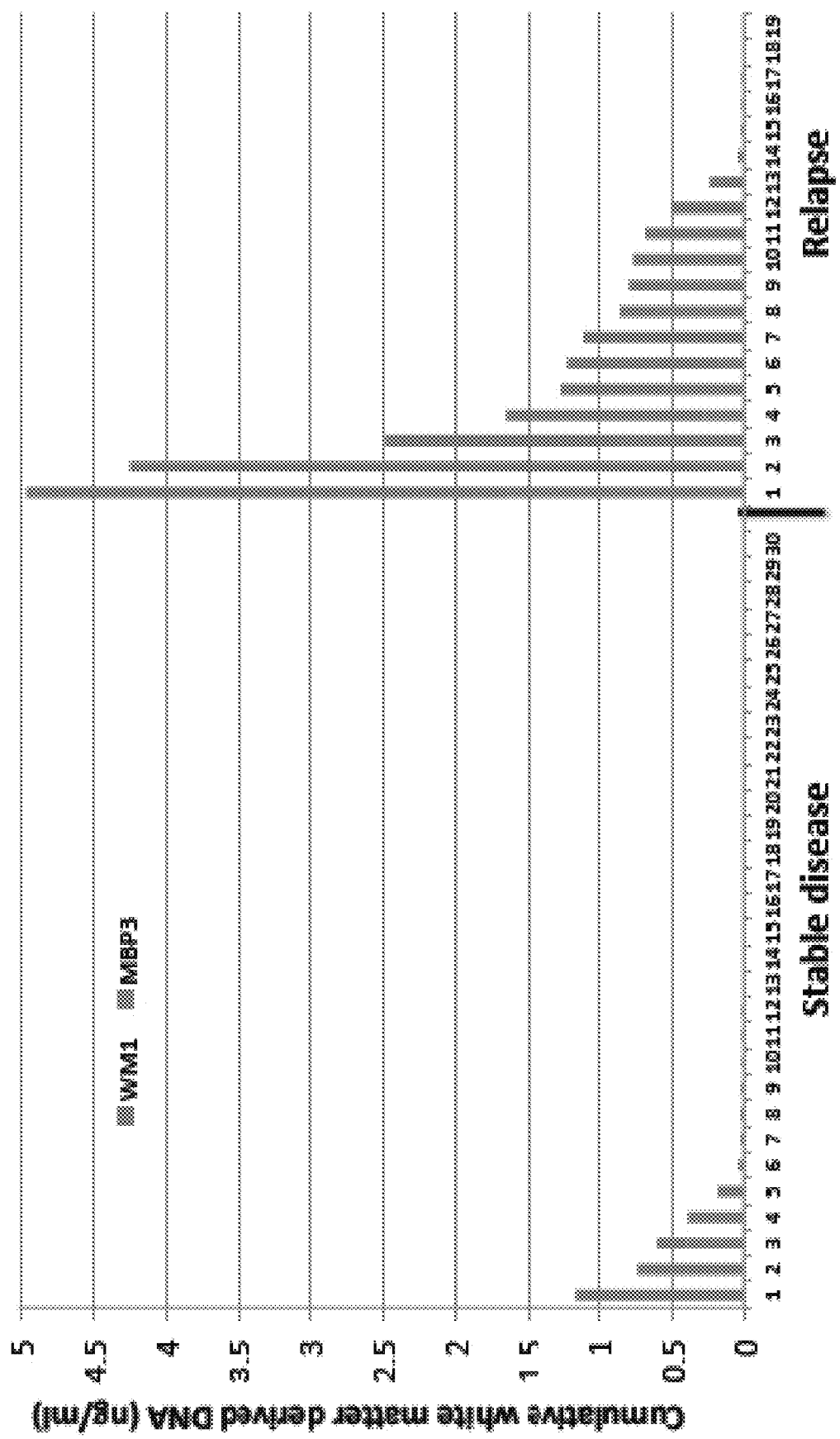

FIGS. 2A-C: identification of oligodendrocyte-derived cfDNA in multiple sclerosis.

A, methylation status of MBP3 and WM1 in multiple tissues. Note lack of methylation in total brain but not in neuron-rich cerebellum, suggesting that unmethylated molecules derived from glia (see also FIGS. 8A-E and 9A-E).

B, oligodendrocyte-derived DNA in the plasma of healthy individuals.

C, oligodendrocyte-derived DNA in the plasma of remitting and relapsing MS/NMO patients. Graph shows the cumulative values of unmethylated MBP3 and WM1 in each sample. Controls vs stable disease, p=0.6; controls vs relapsing disease, p<0.0001; stable vs relapsing disease, p<0.0001; controls vs all patients, p=0.021.

FIGS. 3A-D: identification of brain-derived cfDNA after brain damage.

A, methylation status of CpG sites at the CG09787504 locus (Brain1) in multiple tissues, as determined by deep sequencing. Bars represent the percentage of molecules in which all 9 CpGs of the locus are unmethylated.

B, brain-derived DNA in the plasma of 12 healthy volunteers, calculated by multiplying the fraction of fully unmethylated Brain1 molecules by the amount of cfDNA in each individual.

C, brain-derived DNA in the plasma of 10 patients after cardiac arrest. Each patient was sampled immediately after resuscitation ("acute") and at subsequent time points. Labels mark patients that survived ("alive") or died, and the cause of death (cerebral, cardiac or respiratory). Controls vs patients (all time points), p<0.0001.

D, brain-derived DNA in the plasma of 5 patients after traumatic brain injury, sampled at different days after admission to a neurotrauma unit. After one year, two patients remained with impaired neurological score, two patients recovered, and one patient did not survive, as indicated. Controls vs patients (all time points), p=0.005.

Figure 4C:
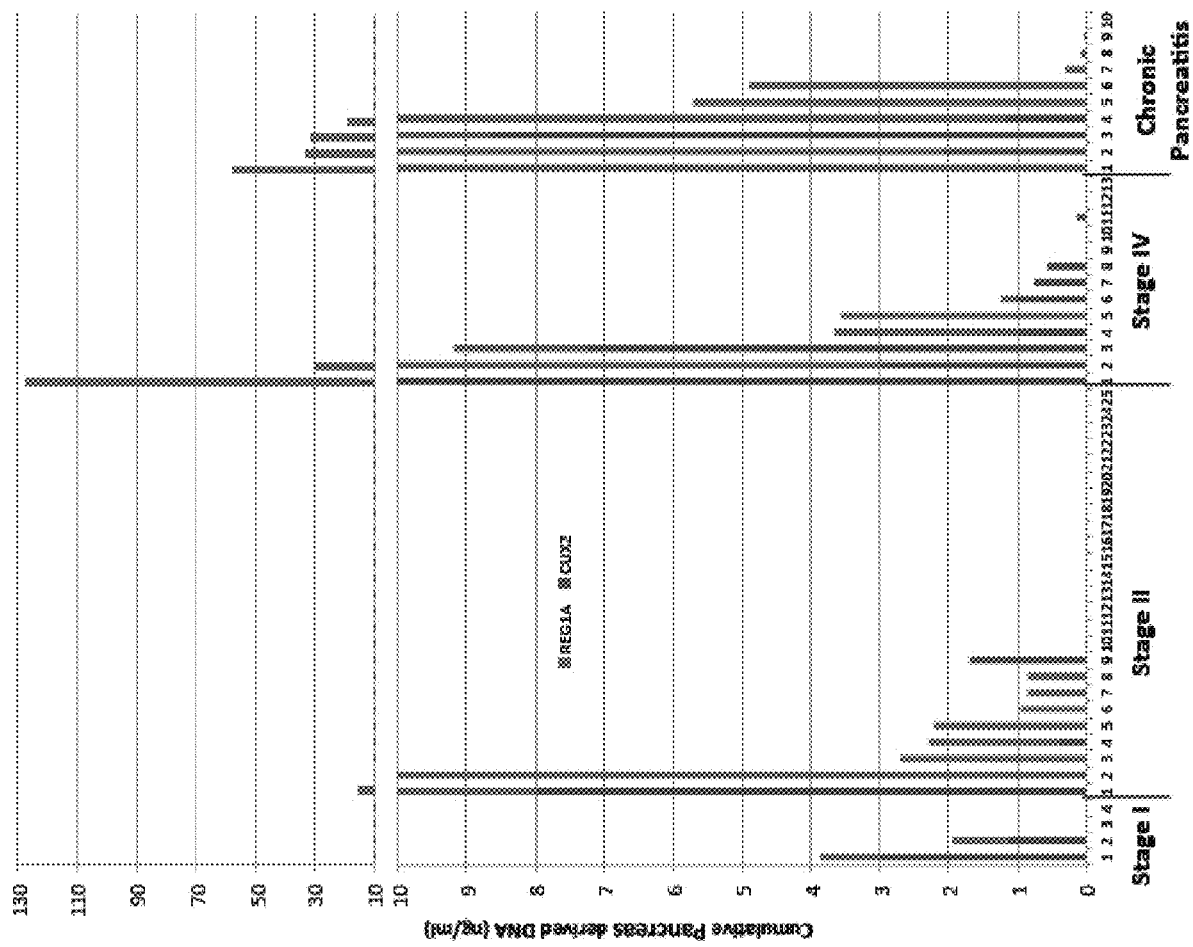

FIGS. 4A-C: identification of exocrine pancreas-derived cfDNA in patients with pancreatic cancer or pancreatitis.

A, methylation status of CpG clusters in the CUX2 and REG1A loci, in multiple tissues. While CUX2 appears to be unmethyalated selectively in ducts, REG1A is unmethylated in both ducts and acinar cells, but also in ~30% of colon cells.

B, levels of unmethylated CUX2 and REG1A DNA fragments in the plasma of healthy individuals.

C, levels of unmethylated exocrine pancreas markers in the plasma of patients with pancreatic cancer or chronic pancreatitis. The graph shows the intensity of signal from each marker for each patient, after reducing the background signal (the highest signal seen among healthy controls). Controls vs all cancer patients, p<0.0001; controls vs localized cancer, p<0.0001; controls vs metastatic disease, p<0.0001; localized vs metastatic cancer, p=0.047; controls vs pancreatitis, p<0.0001.

Figure 5A:
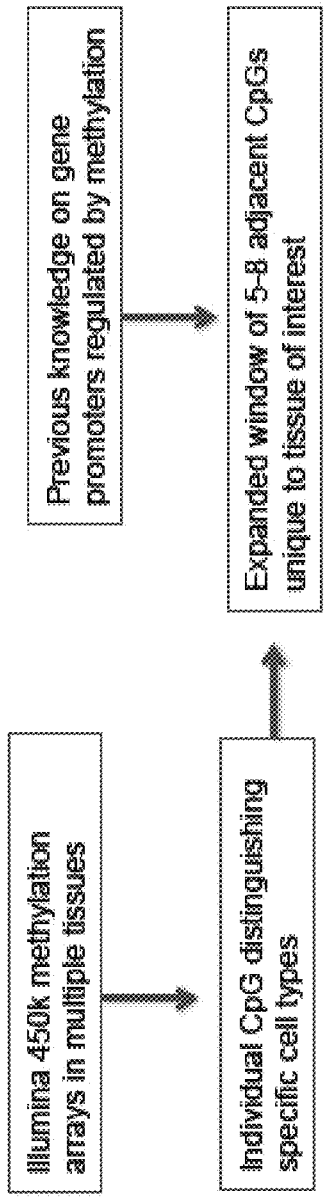
Figure 5B:
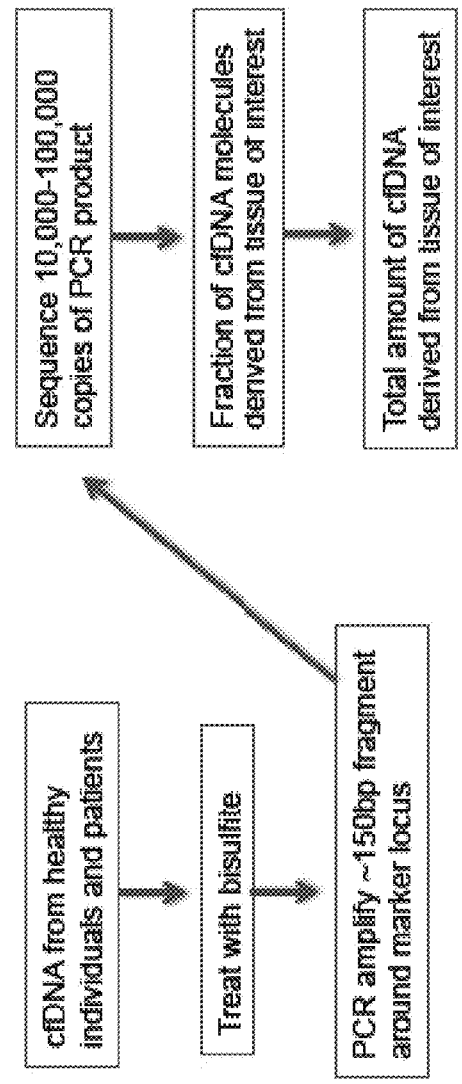

FIGS. 5A-B: flow chart of method to detect circulating DNA derived from a specific tissue.

A, procedure to identify tissue-specific methylation markers.

B, procedure to determine levels of tissue-specific DNA in plasma.

Figure 6A:
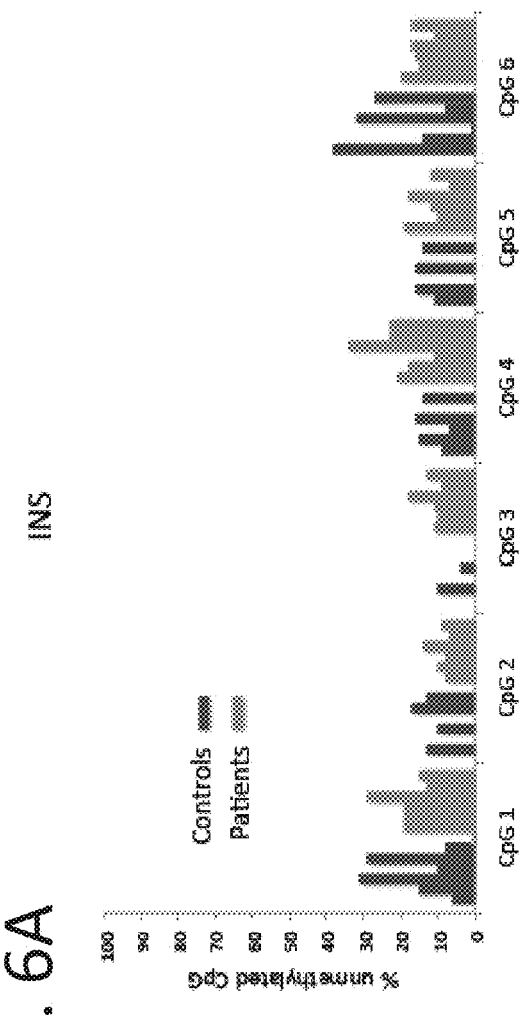
Figure 6B:
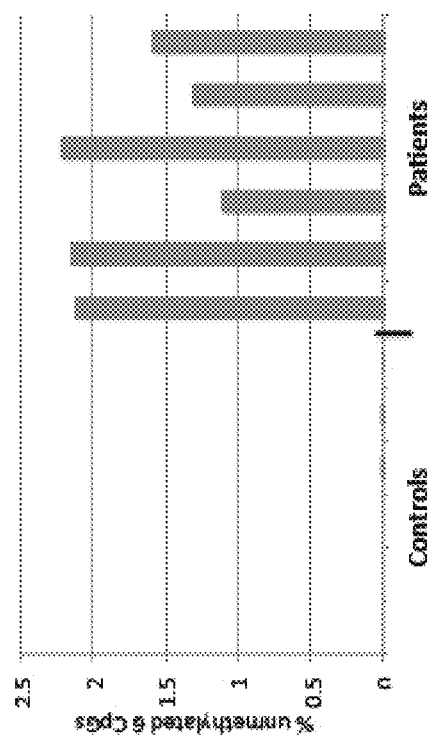
Figure 7C:
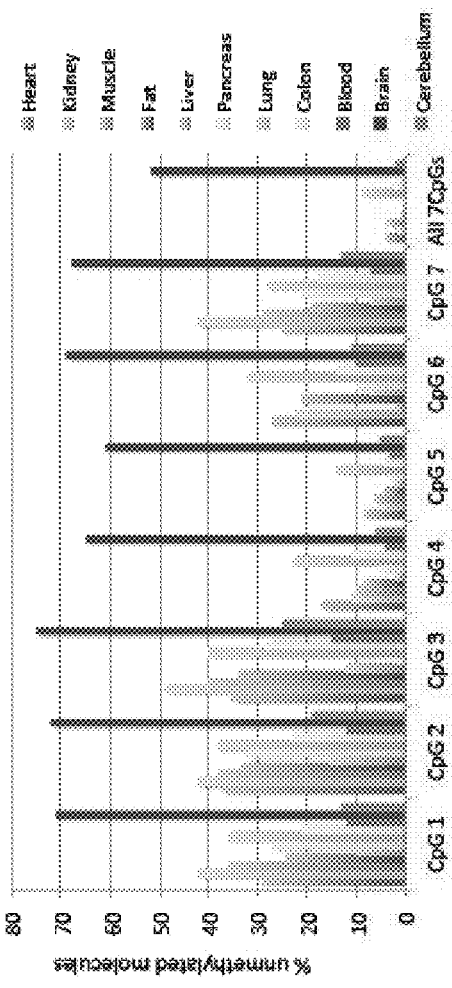
Figure 7D:
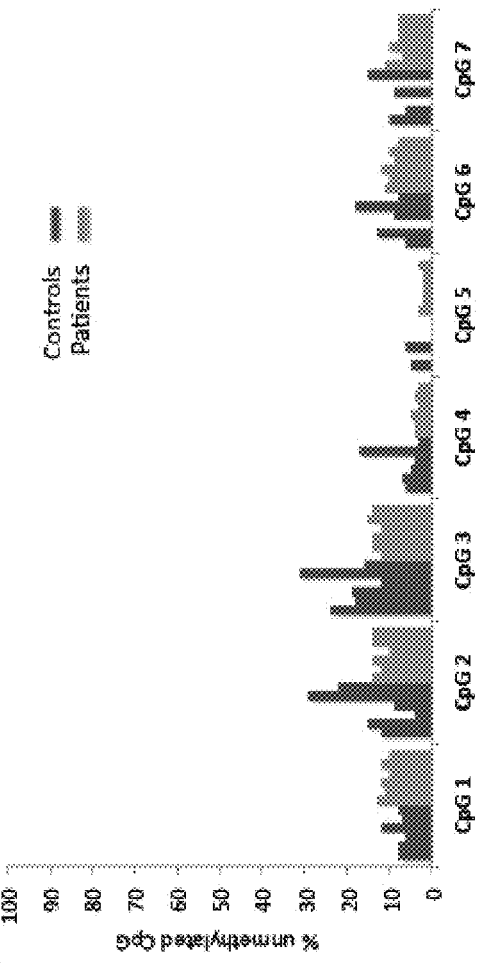
Figures 8A, 8B:
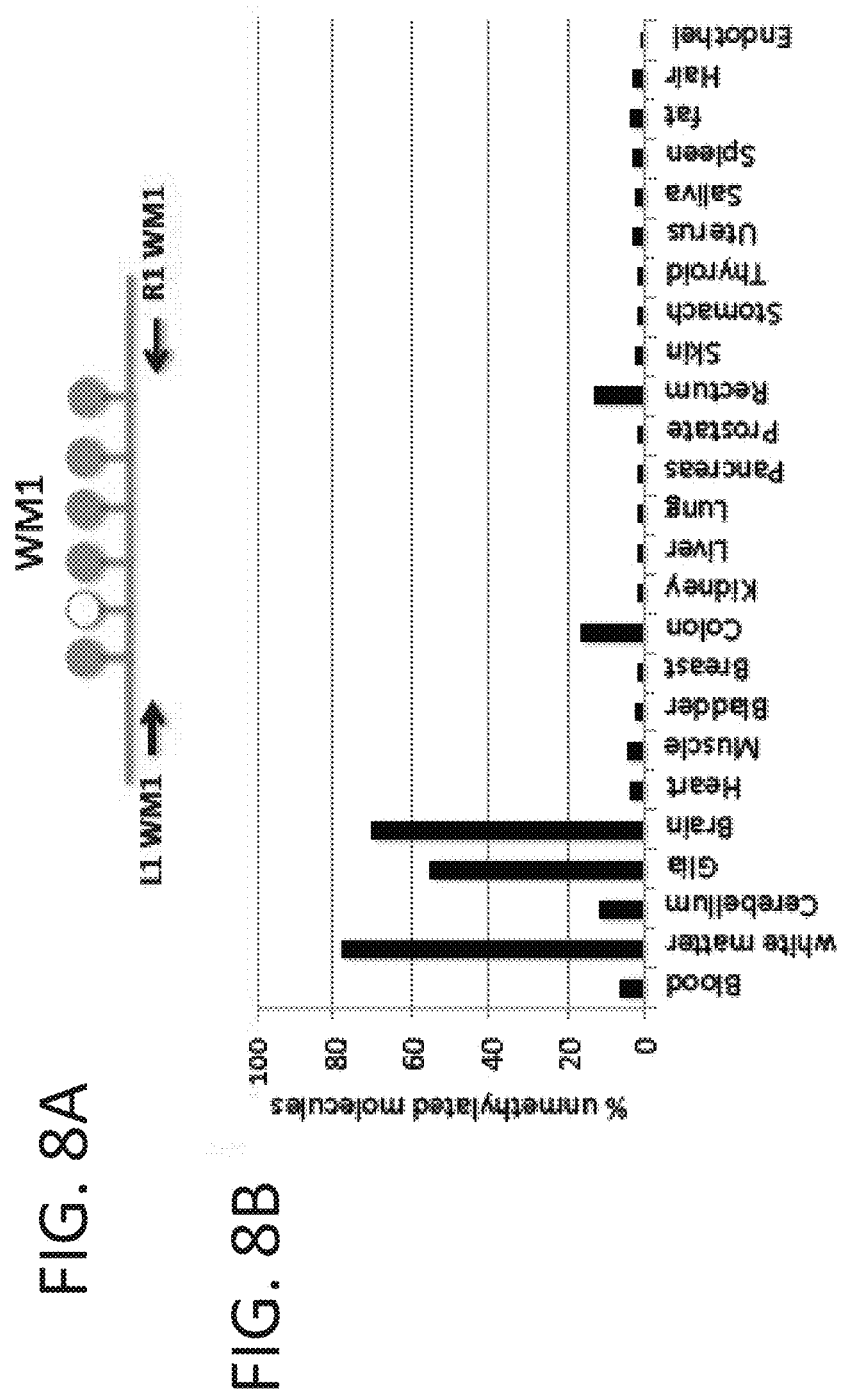
Figure 8D:
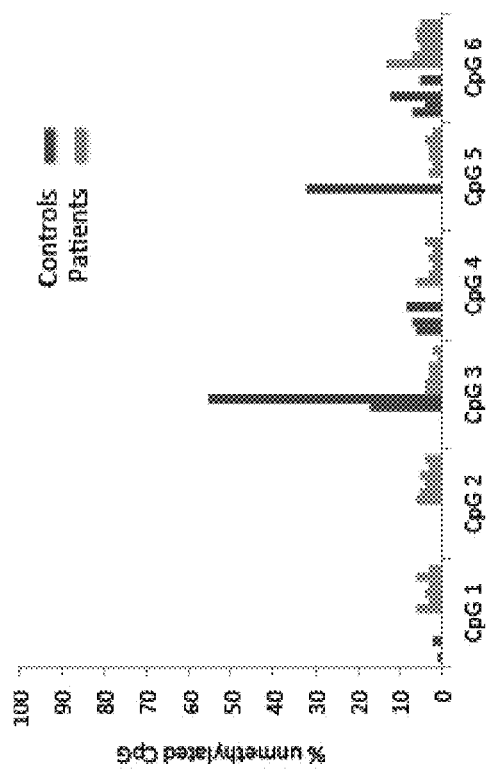
Figure 8E:
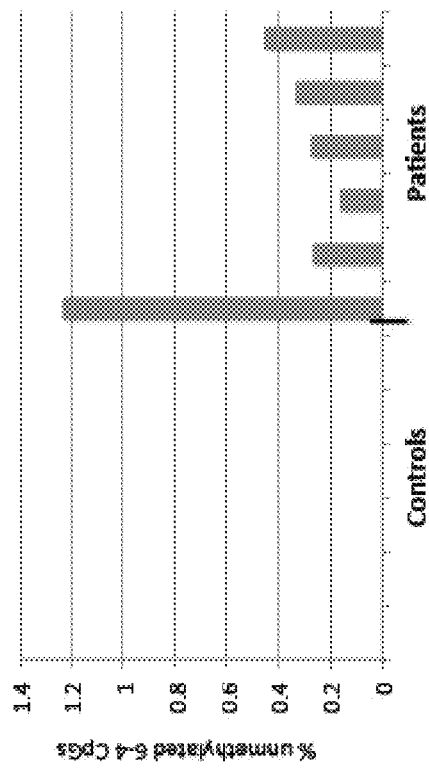
Figures 9A, 9B:
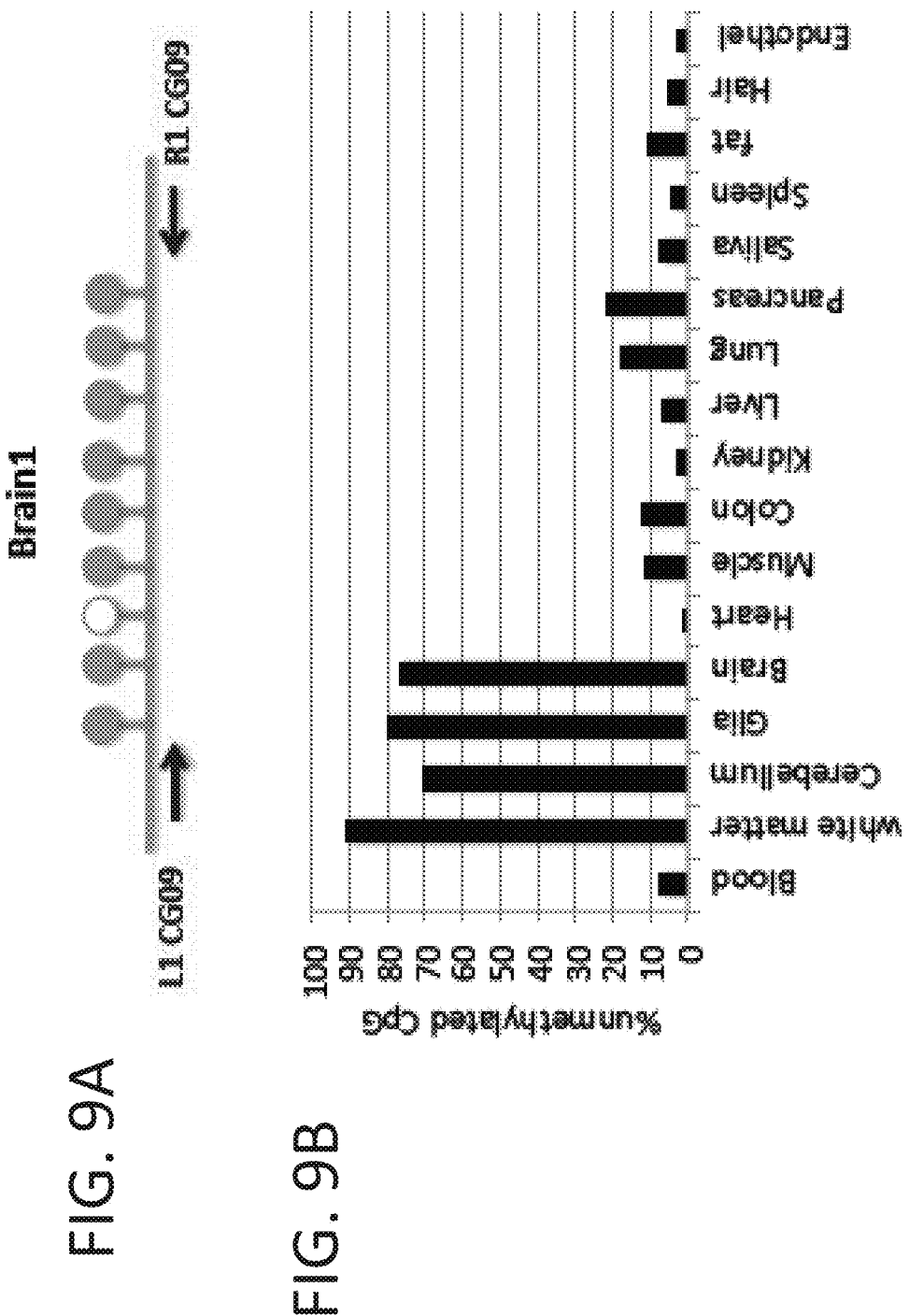
Figure 9C:
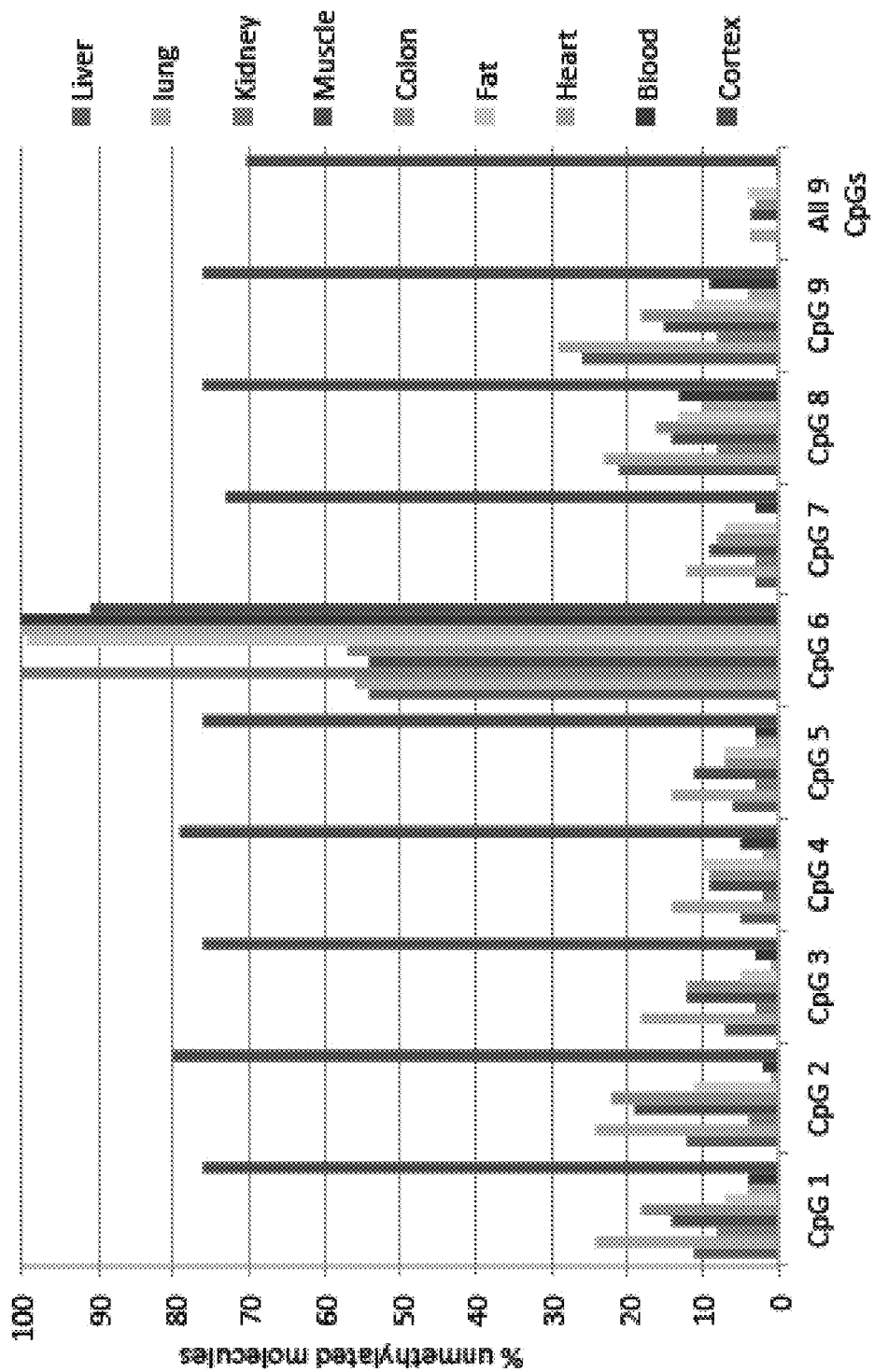
Figure 9D:
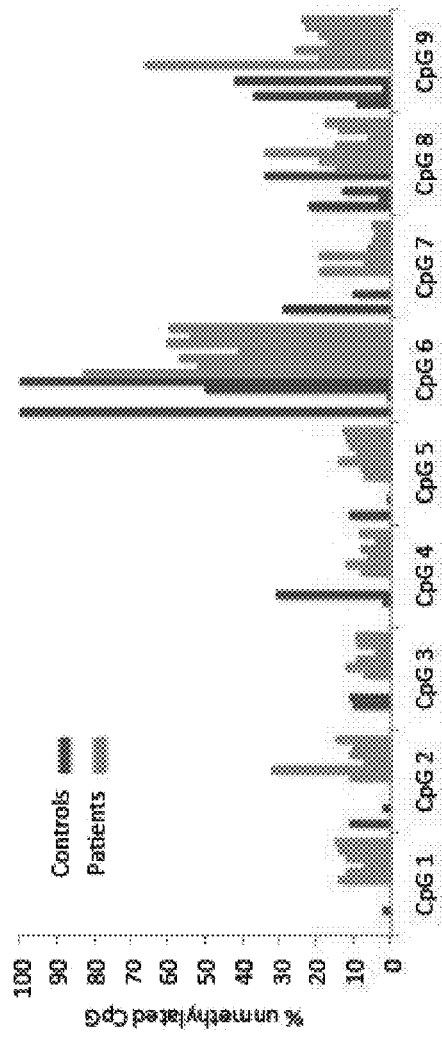
Figure 9E:
Figures 10A, 10B:
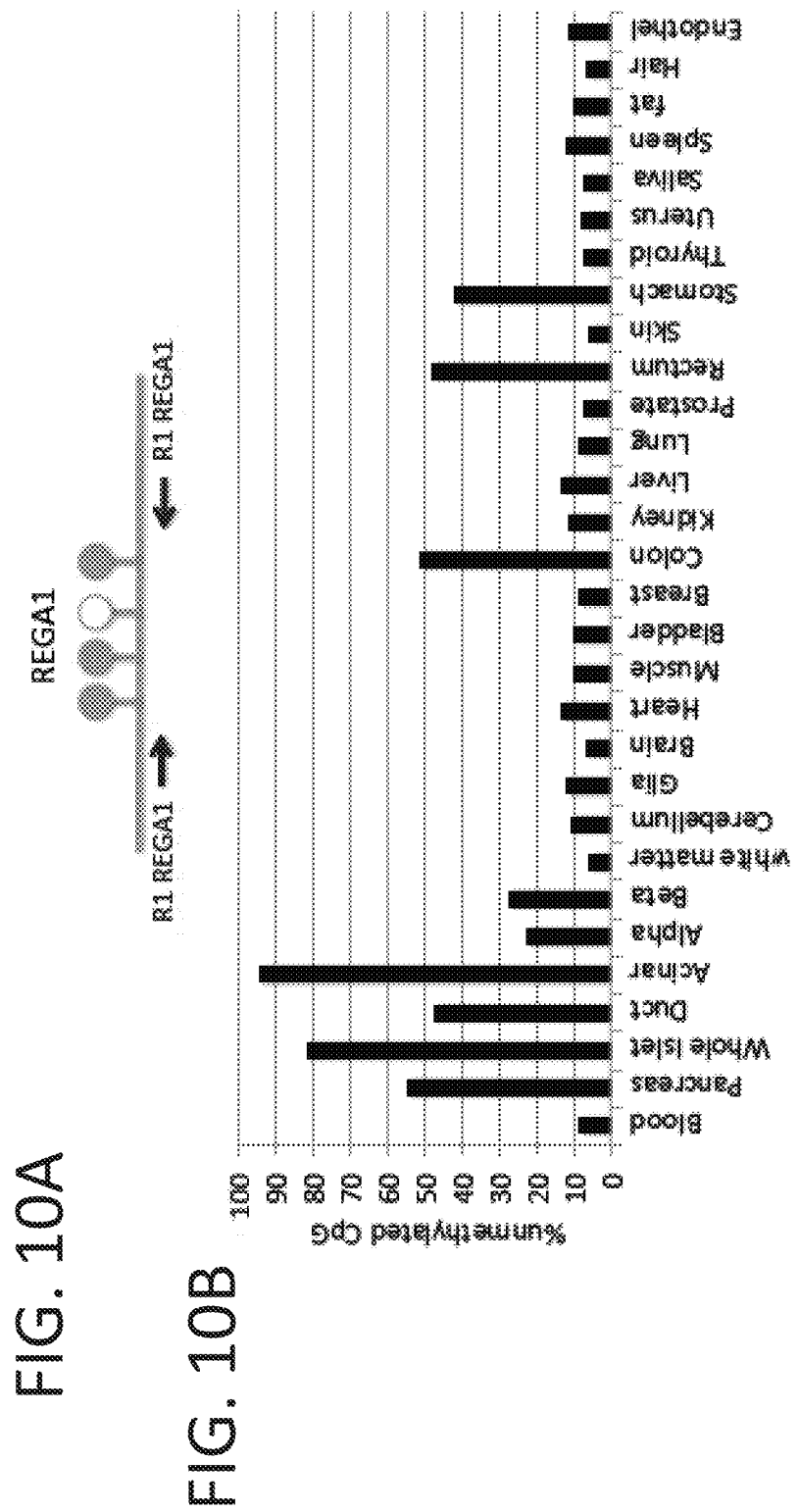
Figure 10C:
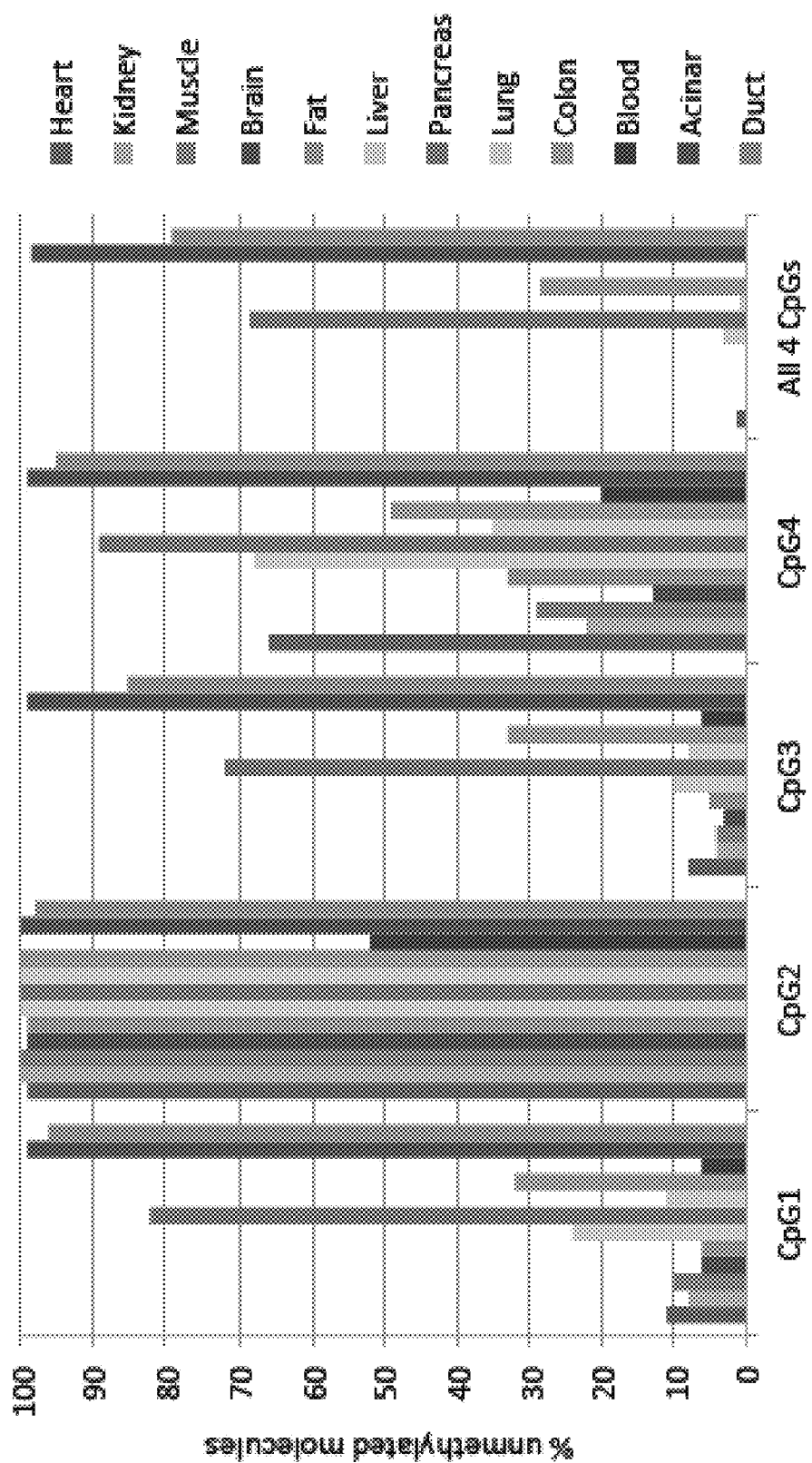
Figure 10D:
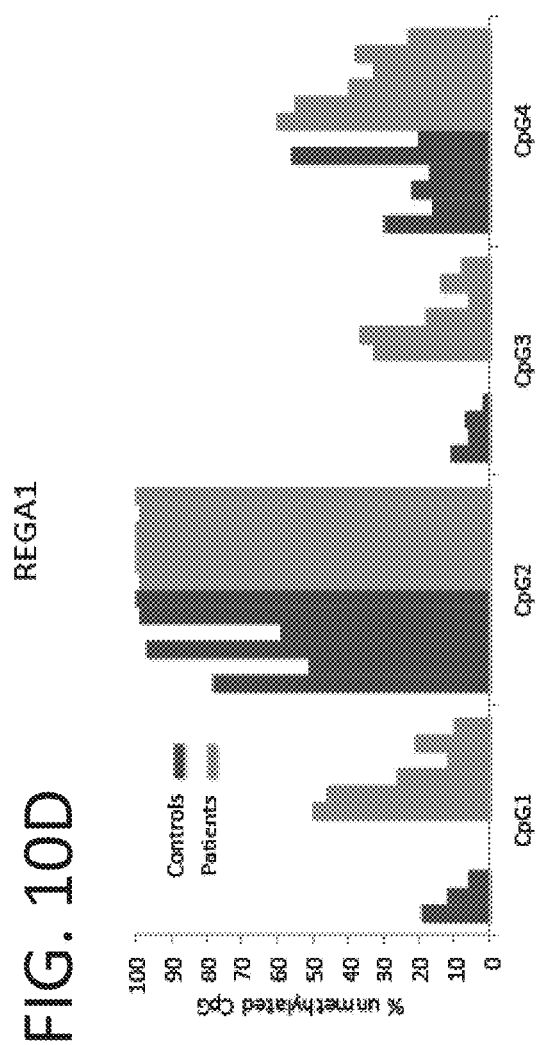
Figure 10E:
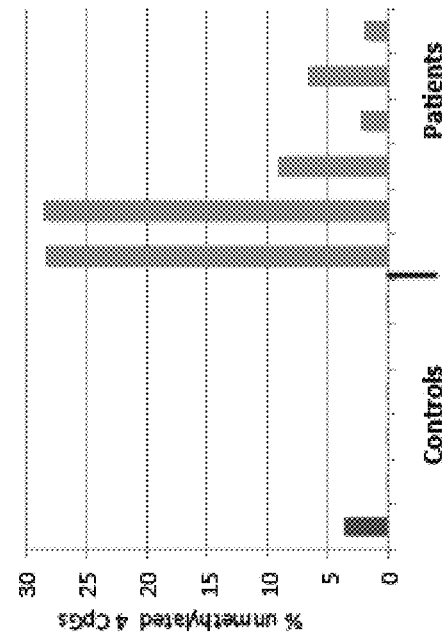
Figures 11A, 11B:
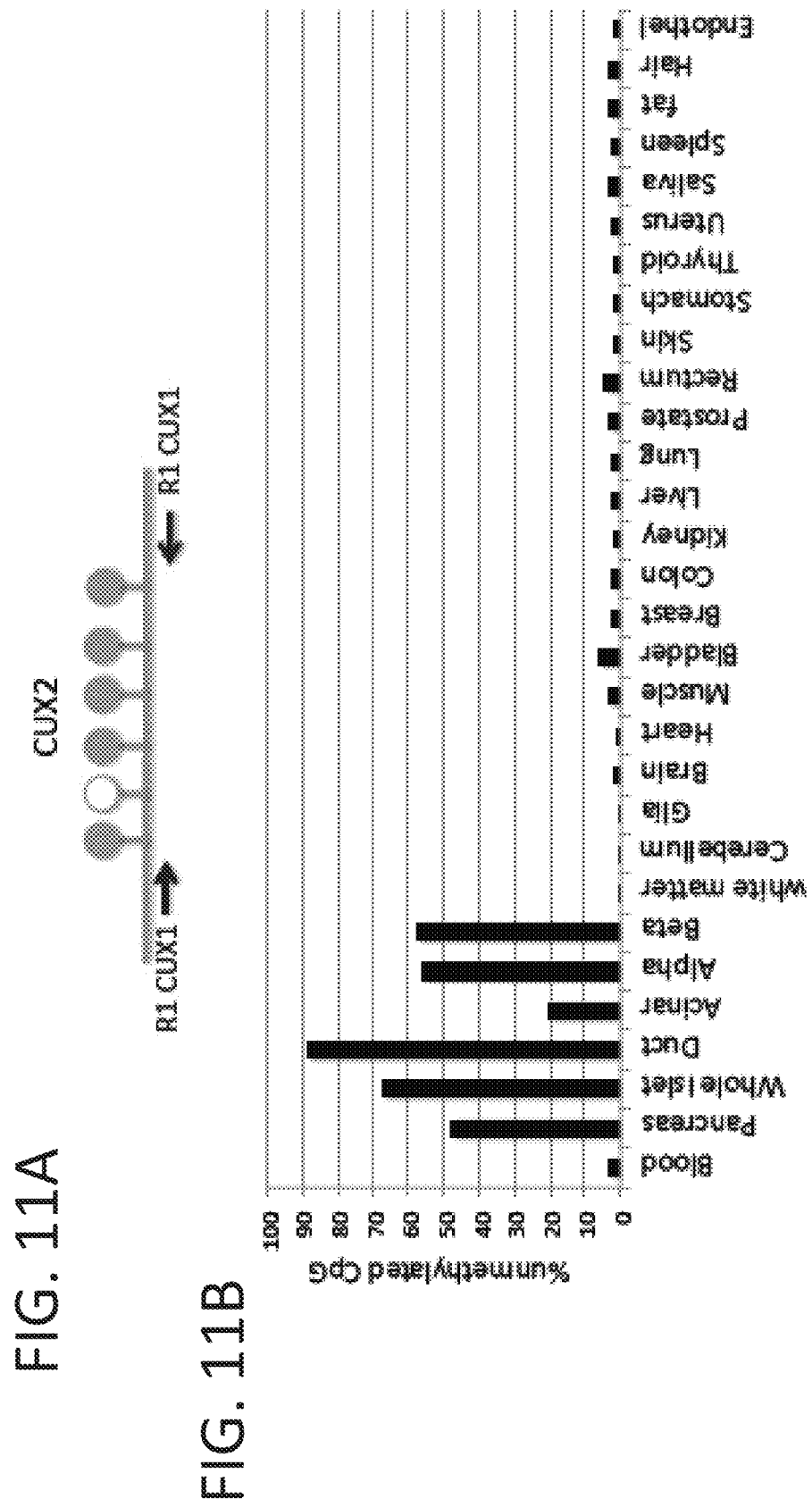
Figure 11C:
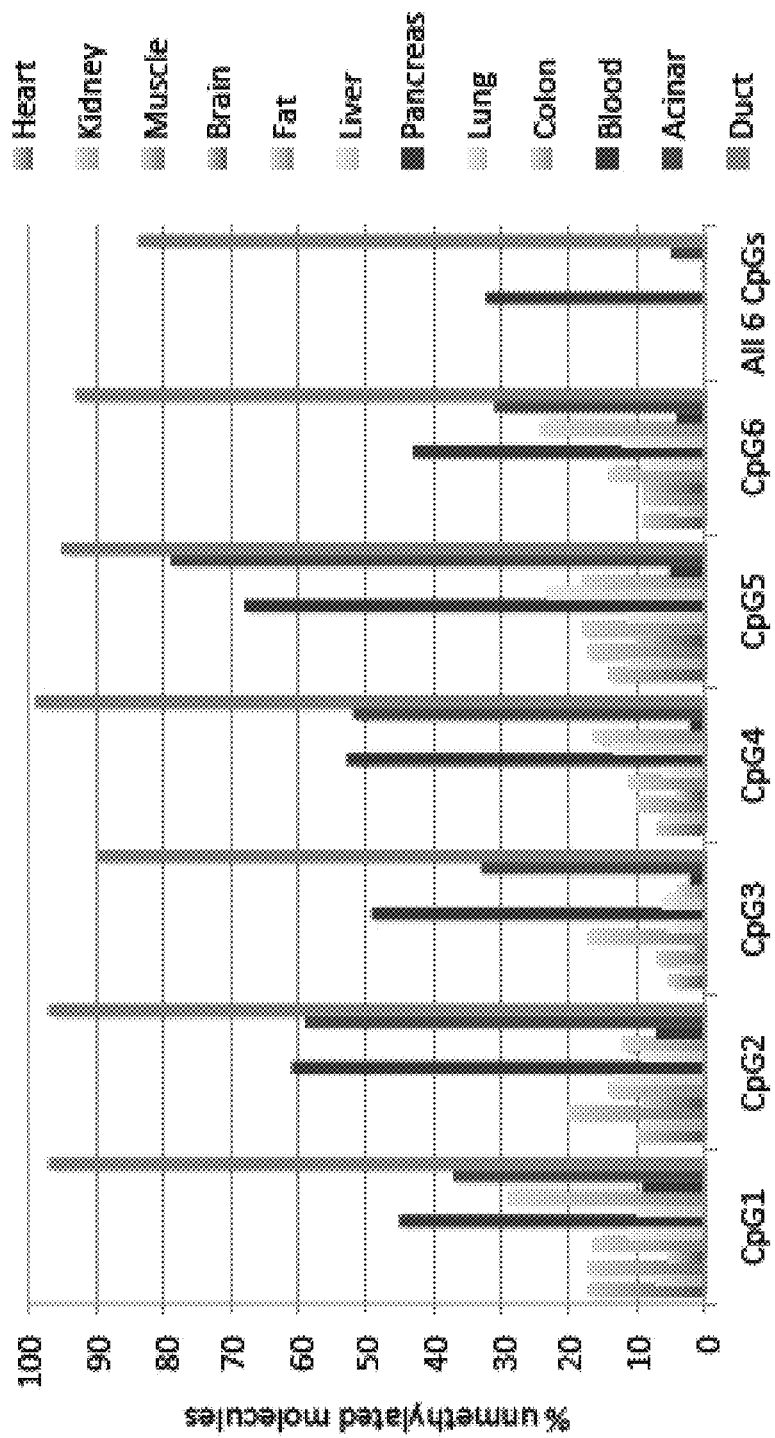
Figure 11D:
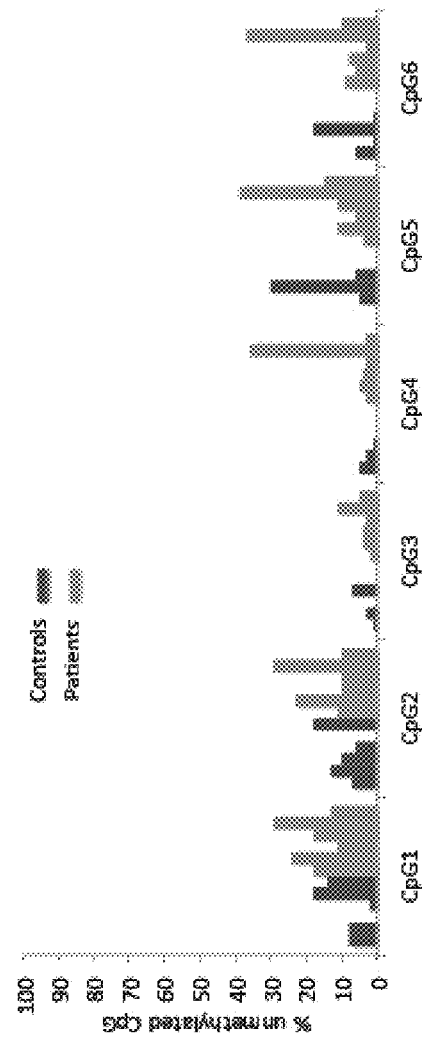
Figure 11E:
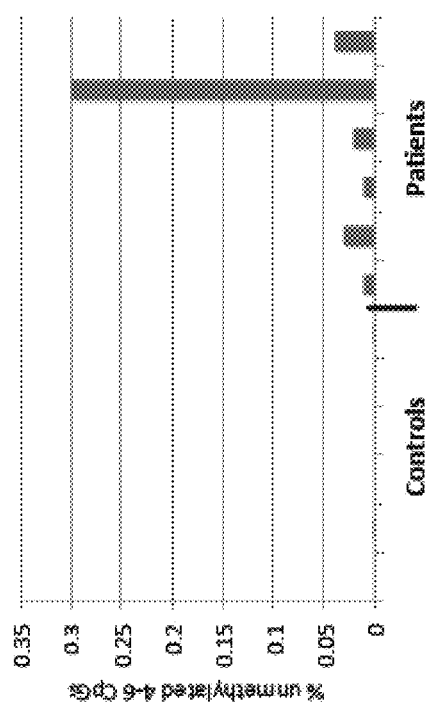

FIGS. 6A-B: methylation of the insulin gene promoter in the plasma of healthy volunteers and recently diagnosed T1D patients.

A, methylation status of individual CpG sites at the insulin gene promoter.

B, methylation status of an expanded window of 4-6 CpGs expressed as % unmethylated DNA, in the same patients as in panel A.

FIGS. 7A-E: methylation of the 3' UTR of MBP3.

A, structure of the MBP3 3' UTR fragment used as marker. Lollipops represent CpGs. Empty lollipop represents the CpG detected in the Illumina 450 k array. Arrows mark positions of PCR primers.

B, methylation status of the individual CpG site at the MBP3 locus that is captured in the Illumina 450 k array. Data from publicly available 450 k arrays.

C, methylation status of individual CpG sites and an expanded window of multiple CpGs from the MBP3 locus, in multiple tissues, as determined by deep sequencing.

D, methylation of individual CpG sites from the MBP3 locus in the plasma of healthy controls and relapsing MS/NMO patients.

E, fraction of fully unmethylated MBP3 locus fragment in the plasma of healthy volunteers and MS/NMO patients (same patients as in panel D). Total unmethylated MBP3 locus DNA expressed in ng/ml plasma is shown in FIG. 2C.

FIGS. 8A-E: methylation of CG10809560 and adjacent CpG sites (the WM1 locus). A, structure of the WM1 locus fragment used as marker. Lollipops represent CpGs. Empty lollipop represents the CpG detected in the Illumina 450 k array. Arrows mark positions of PCR primers.

B, methylation status of WM1 in multiple tissues as recorded in publicly available Illumina 450 k arrays.

C, methylation status of individual CpG sites and expanded window of multiple CpGs from the WM1 locus, in multiple tissues, as determined by deep sequencing.

D, methylation of individual CpG sites from the WM1 locus in the plasma of healthy controls and relapsing MS/NMO patients.

E, fraction of fully unmethylated WM1 DNA fragments in the plasma of healthy volunteers and MS/NMO patients (same patients as in panel D).

FIGS. 9A-E: methylation of brain marker CG09787504 (Brain1) and adjacent CpG sites.

A, structure of Brain1 locus fragment used as marker. Lollipops represent CpGs. Empty lollipop represents the CpG detected in the Illumina 450 k array. Arrows mark positions of PCR primers.

B, methylation status of Brain1 in multiple tissues as recorded in publicly available Illumina 450 k arrays.

C, methylation status of individual CpG sites and expanded window of multiple CpGs from the Brain1 locus, in multiple tissues, as determined by deep sequencing. D, methylation of individual CpG sites from the Brain1 locus in the plasma of healthy controls and patients after cardiac arrest.

E, fraction of fully unmethylated Brain1 DNA fragments in the plasma of healthy volunteers and patients after cardiac arrest (same patients as in panel D).

FIGS. 10A-E: methylation of the CpG cluster near the REG1A gene.

A, structure of the REG1A fragment used as marker. Lollipops represent CpGs.

Empty lollipop represents the CpG detected in the Illumina 450 k array. Arrows mark positions of PCR primers.

B, methylation status of the individual CpG site in the REG1A locus that is captured in the Illumina 450 k array. Data from publicly available 450 k arrays.

C, methylation status of individual CpG sites and expanded window of multiple CpGs from the REG1A locus in multiple tissues, as determined by deep sequencing.

D, methylation of individual CpG sites from the REG1A locus in the plasma of healthy controls and patients with pancreatic cancer.

E, fraction of fully unmethylated REG1A fragment in the plasma of healthy volunteers and patients with pancreatic cancer (same patients as in panel D).

FIGS. 11A-E: methylation of the CpG cluster near the CUX2 gene.

A, structure of the CUX2 fragment used as marker. Lollipops represent CpGs. Empty lollipop represents the CpG detected in the Illumina 450 k array. Arrows mark positions of PCR primers.

B, methylation status of the individual CpG site at the CUX2 locus that is captured in the Illumina 450 k array. Data from publicly available 450 k arrays.

C, methylation status of individual CpG sites and expanded window of multiple CpGs from the CUX2 locus, in multiple tissues, as determined by deep sequencing.

D, methylation of individual CpG sites from the CUX2 locus in the plasma of healthy controls and patients with pancreatic cancer.

E, fraction of fully unmethylated CUX2 fragment in the plasma of healthy volunteers and patients with pancreatic cancer (same patients as in panel D).

Figure 12:
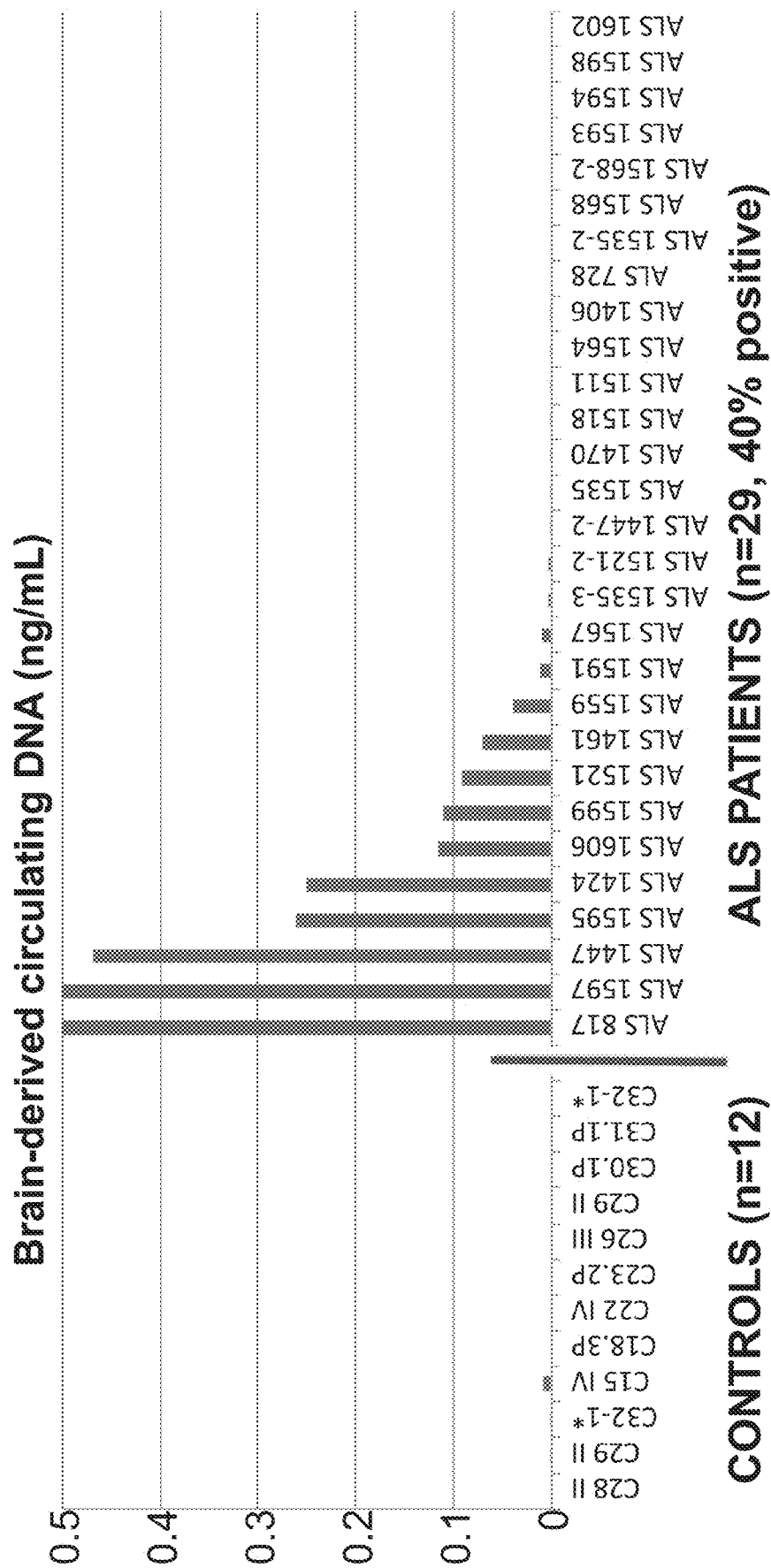

FIG. 12 is a graph illustrating the existence of brain DNA fragments in plasma of some ALS patients.

Figure 13:
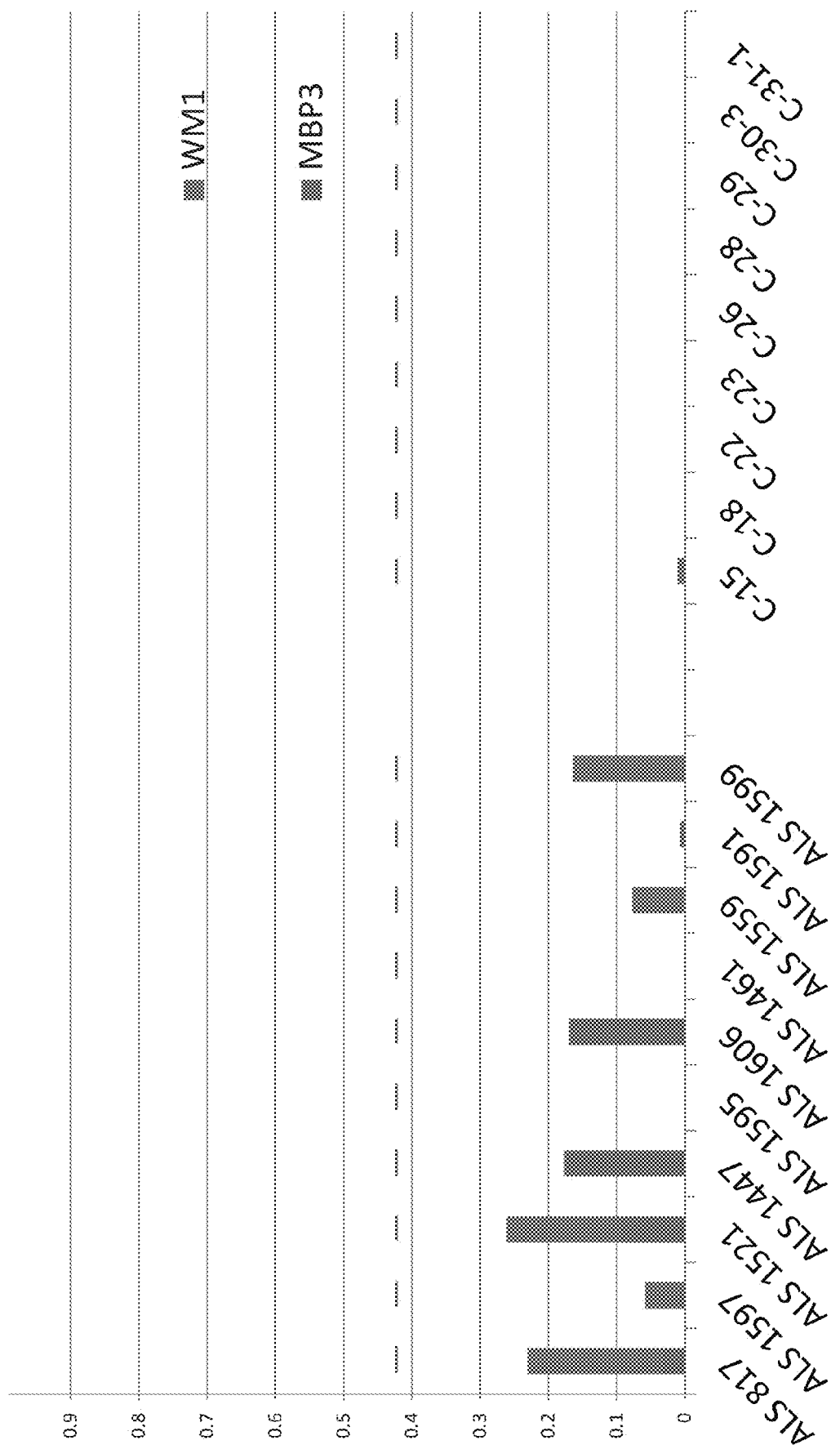

FIG. 13 is a graph illustrating the existence of oligodendrocyte DNA (MBP; SEQ ID NO: 1248) and white matter DNA (WM1; SEQ ID NO: 1247) in plasma of ALS patients (ng/mL serum)

Figure 14A:
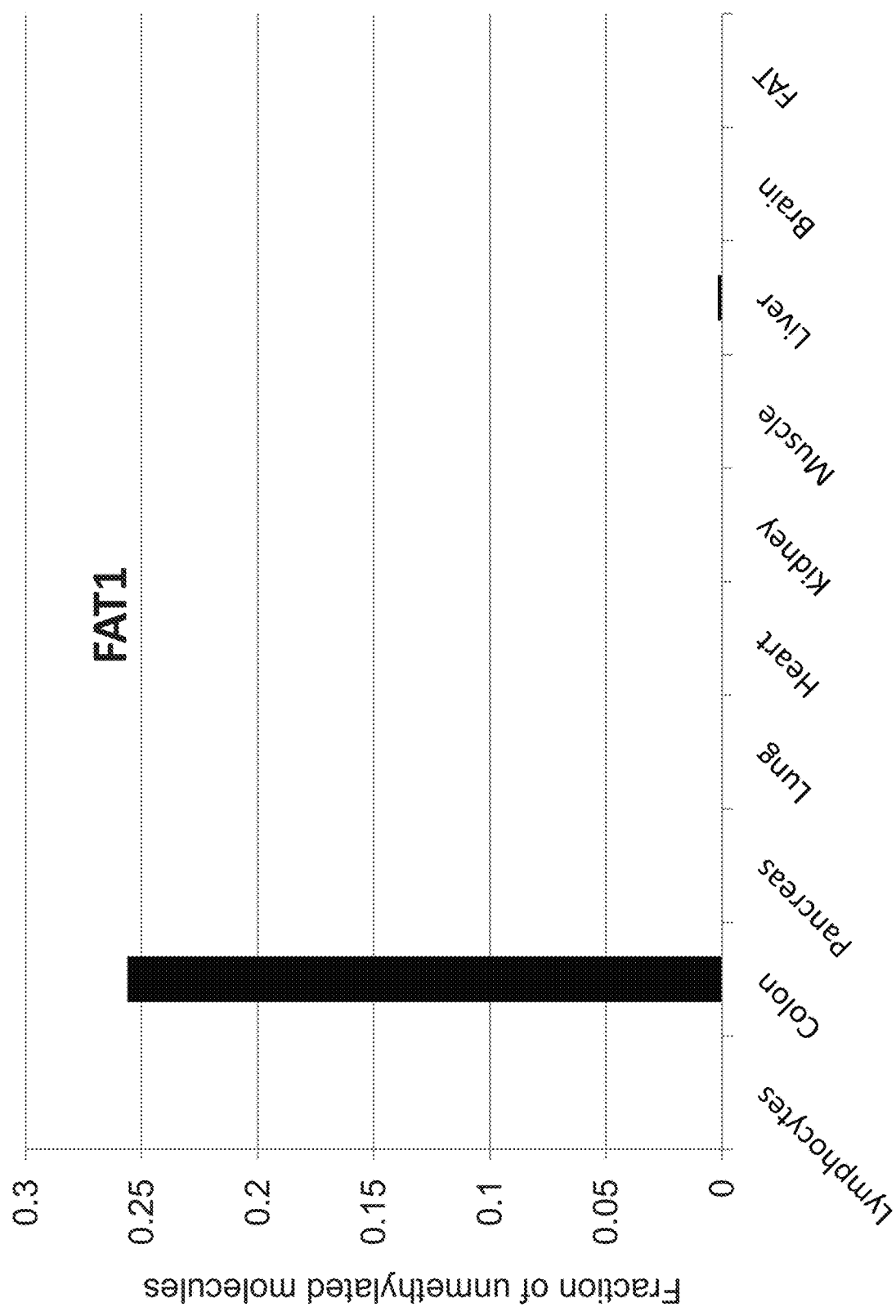
Figure 14B:
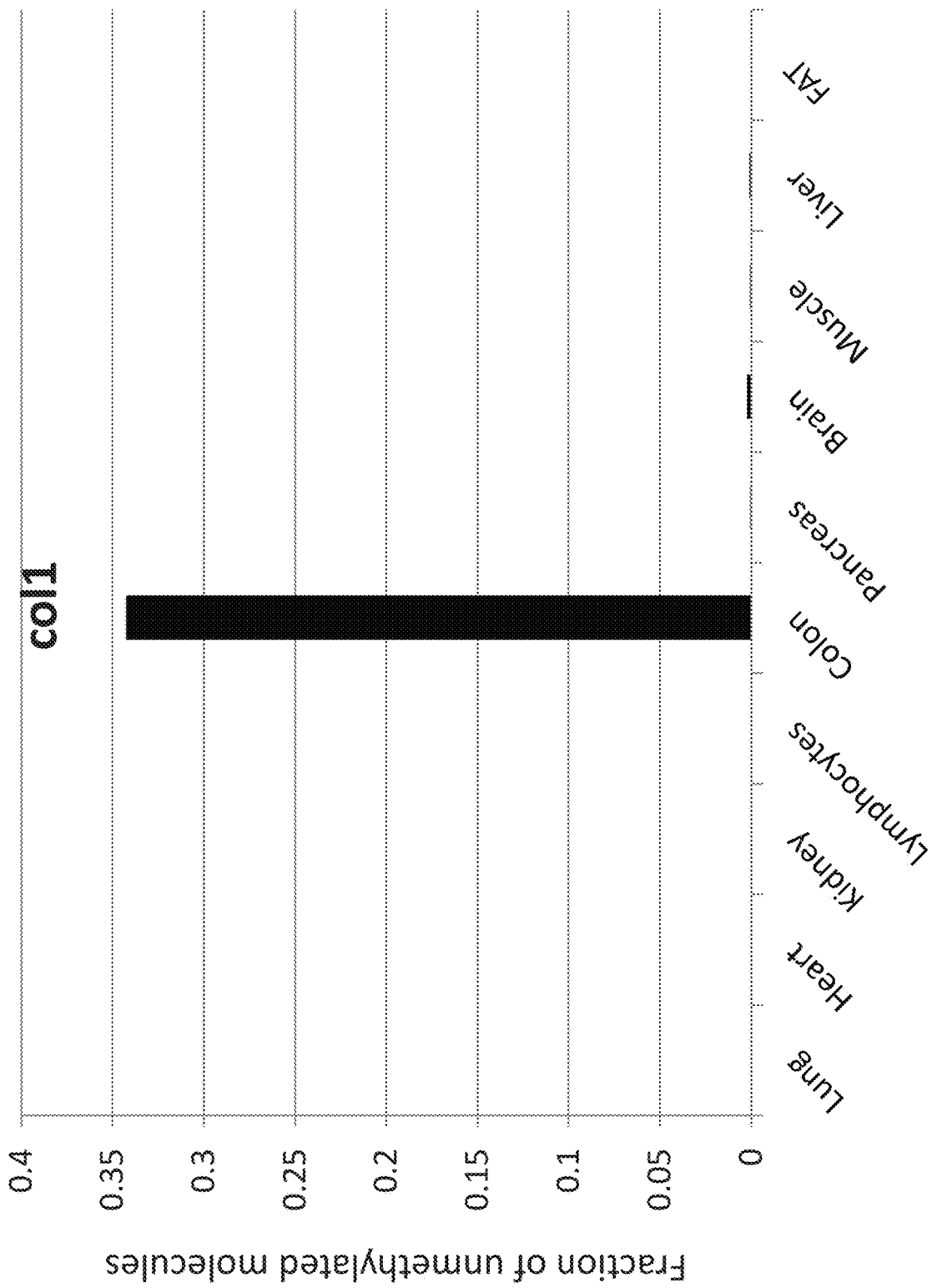
Figure 14C:
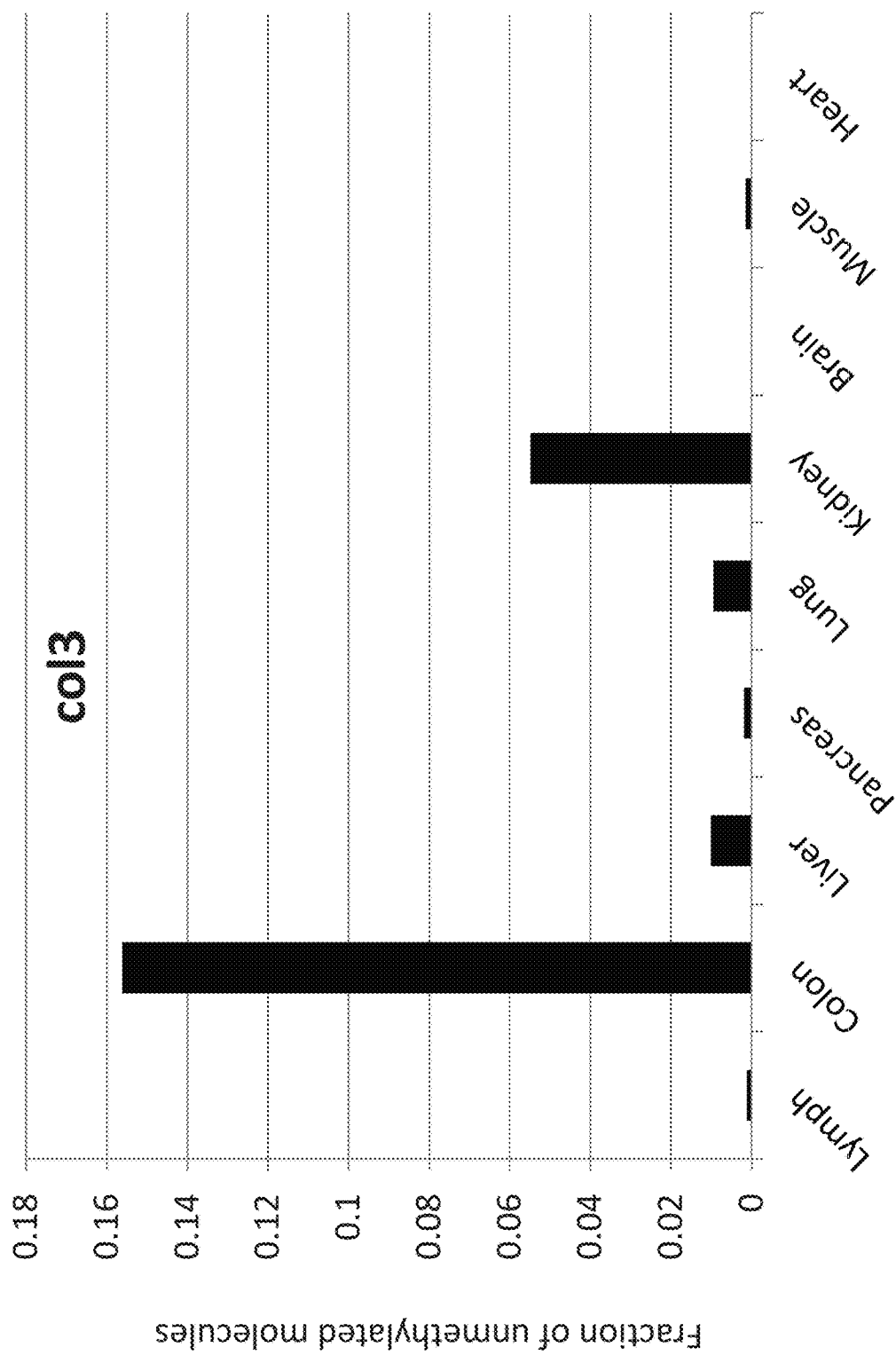
Figure 14D:
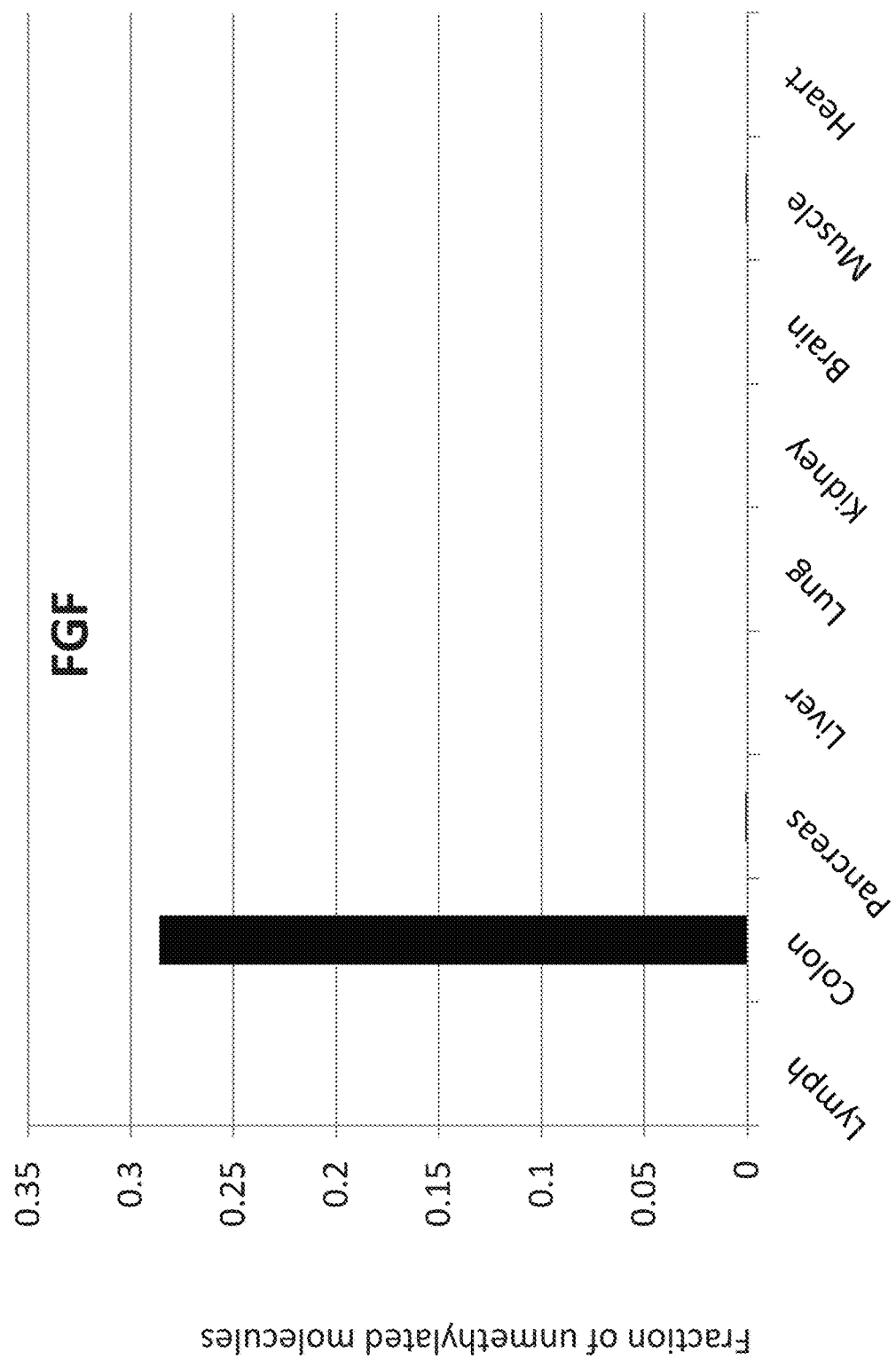

FIGS. 14A-D are graphs illustrating methylation markers for colon epithelial cells. FIG. 14A—sequence comprised in SEQ ID NO: 1258; FIG. 14B—sequence comprised in SEQ ID NO: 1259; FIG. 14C—sequence comprised in 1260; and FIG. 14D—sequence comprised in SEQ ID NO: 1257).

Figure 15:
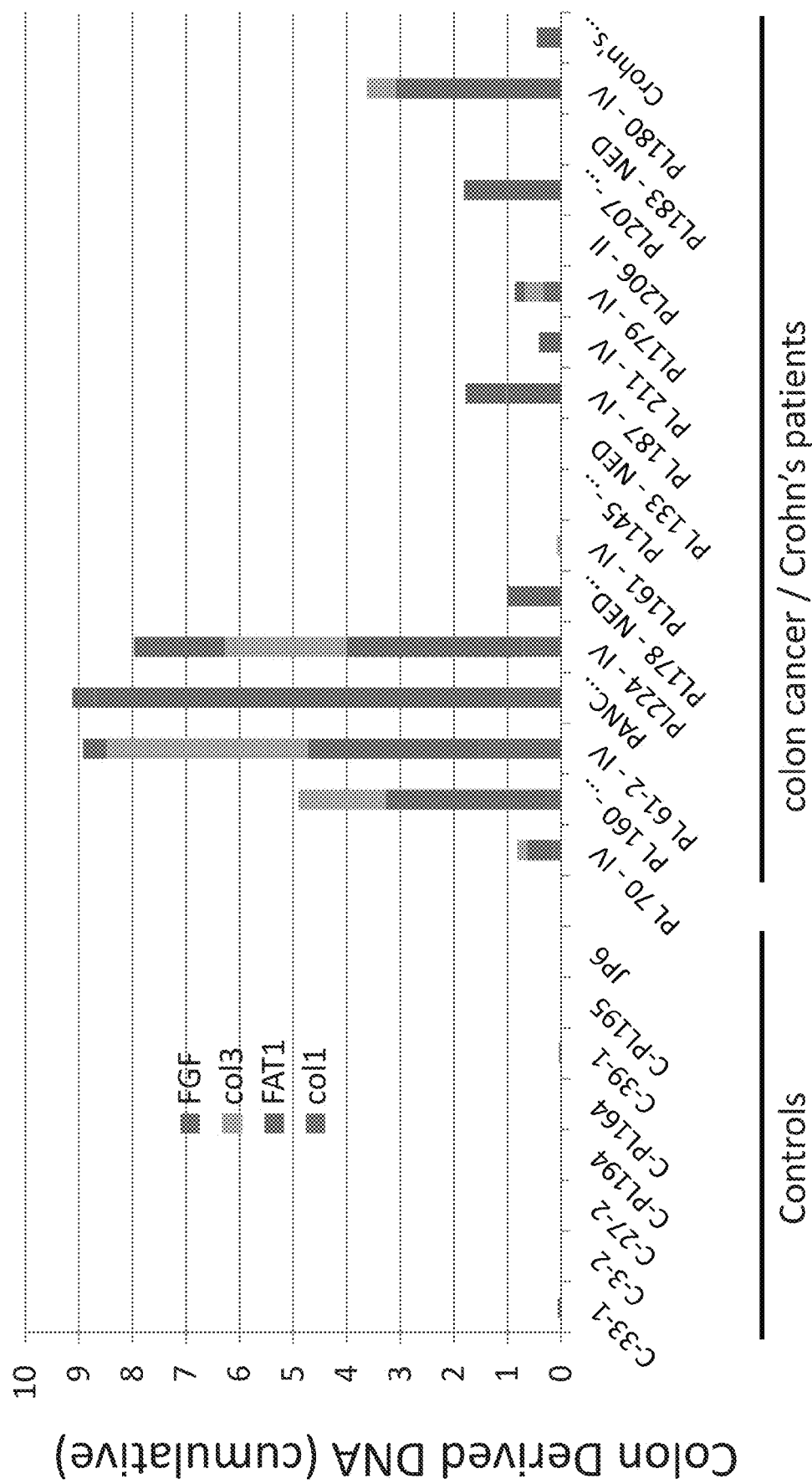

FIG. 15 is a graph illustrating there are no colon DNA fragments in blood of healthy subjects (normal turnover to lumen), whilst there is a presence of colon DNA in blood of patients with colon cancer and Crohn's disease.

Figure 16:
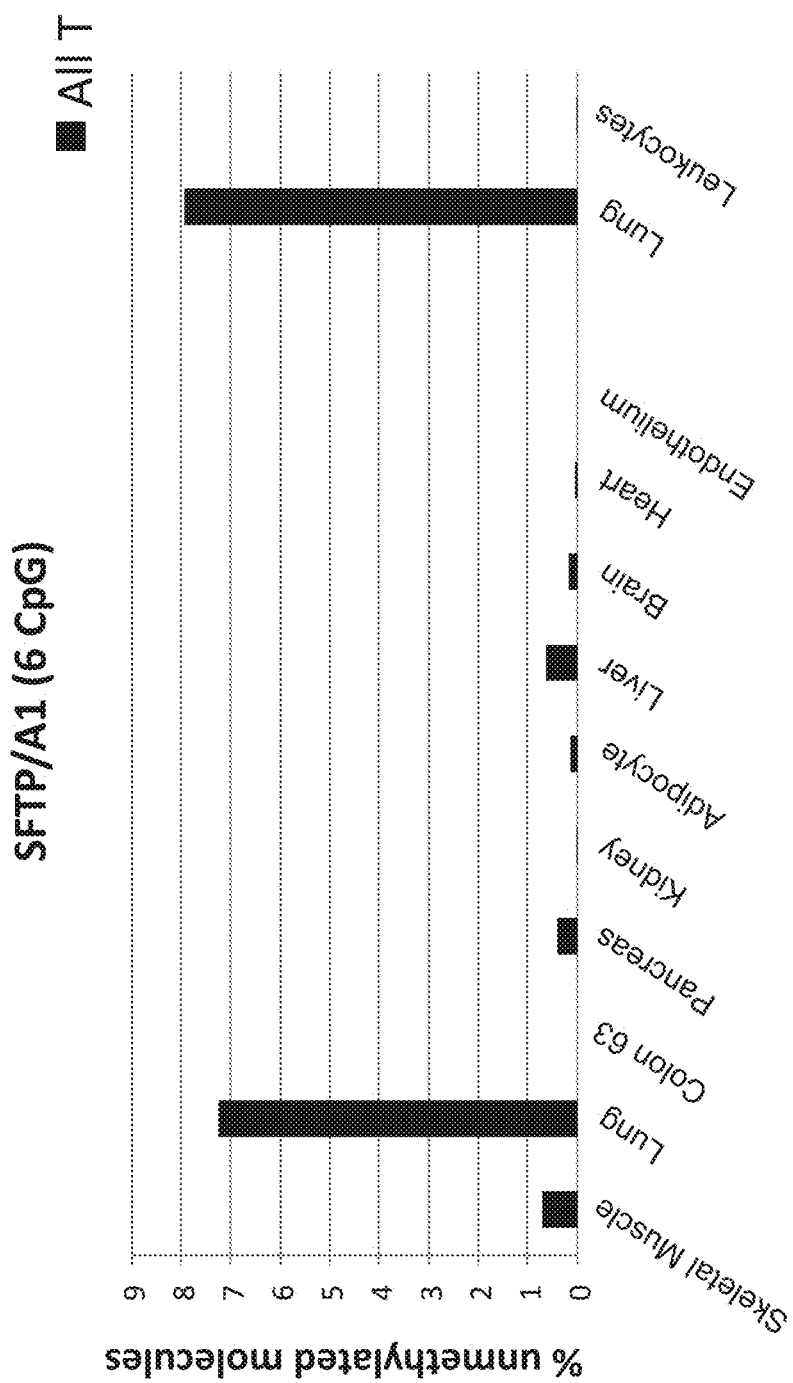

FIG. 16 is a graph illustrating the tissue distribution of unmethylated SFTP/A1 (the sequence comprised in SEQ ID NO: 1268), a lung marker in various tissues.

Figure 17:
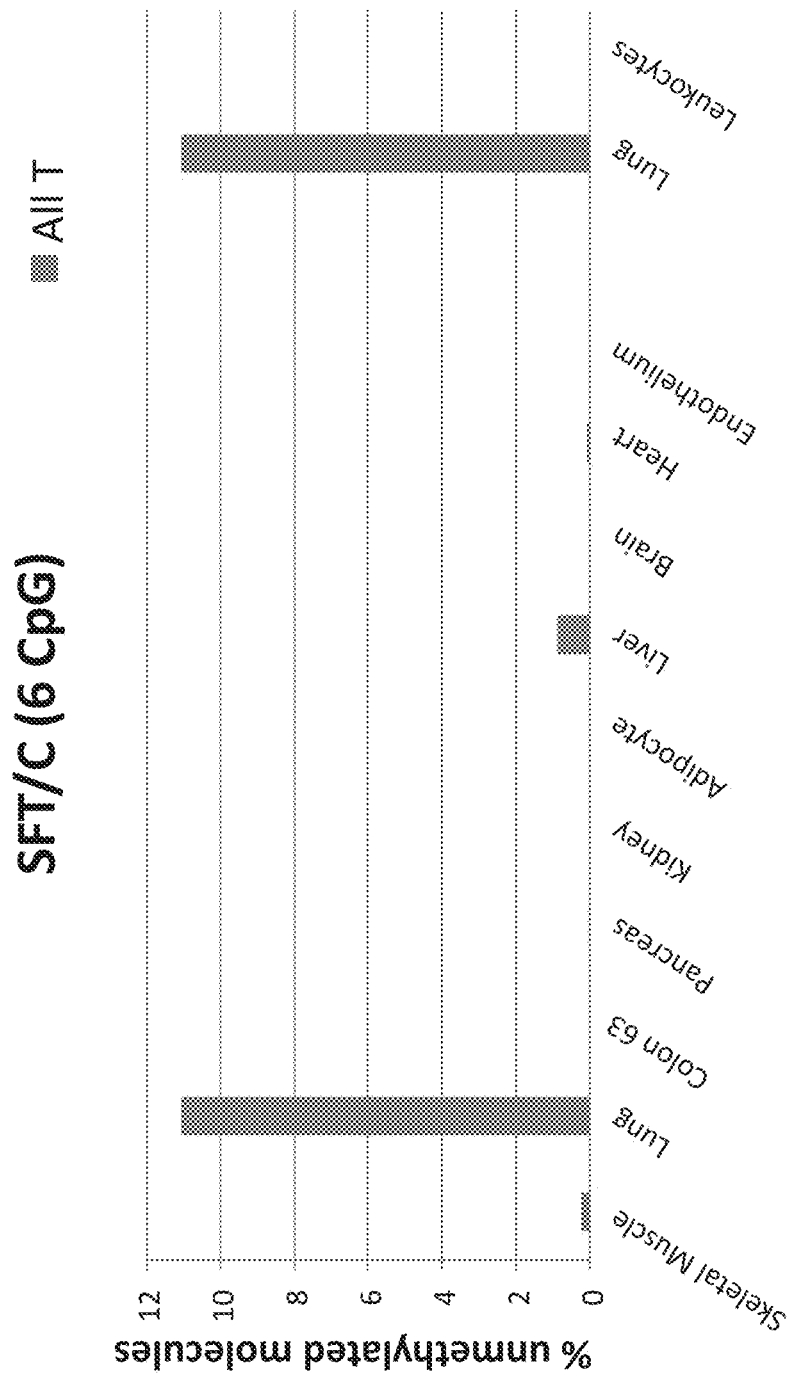

FIG. 17 is a graph illustrating the tissue distribution of unmethylated SFTP/C (the sequence comprised in SEQ ID NO: 1273), a lung marker in various tissues.

Figure 18:
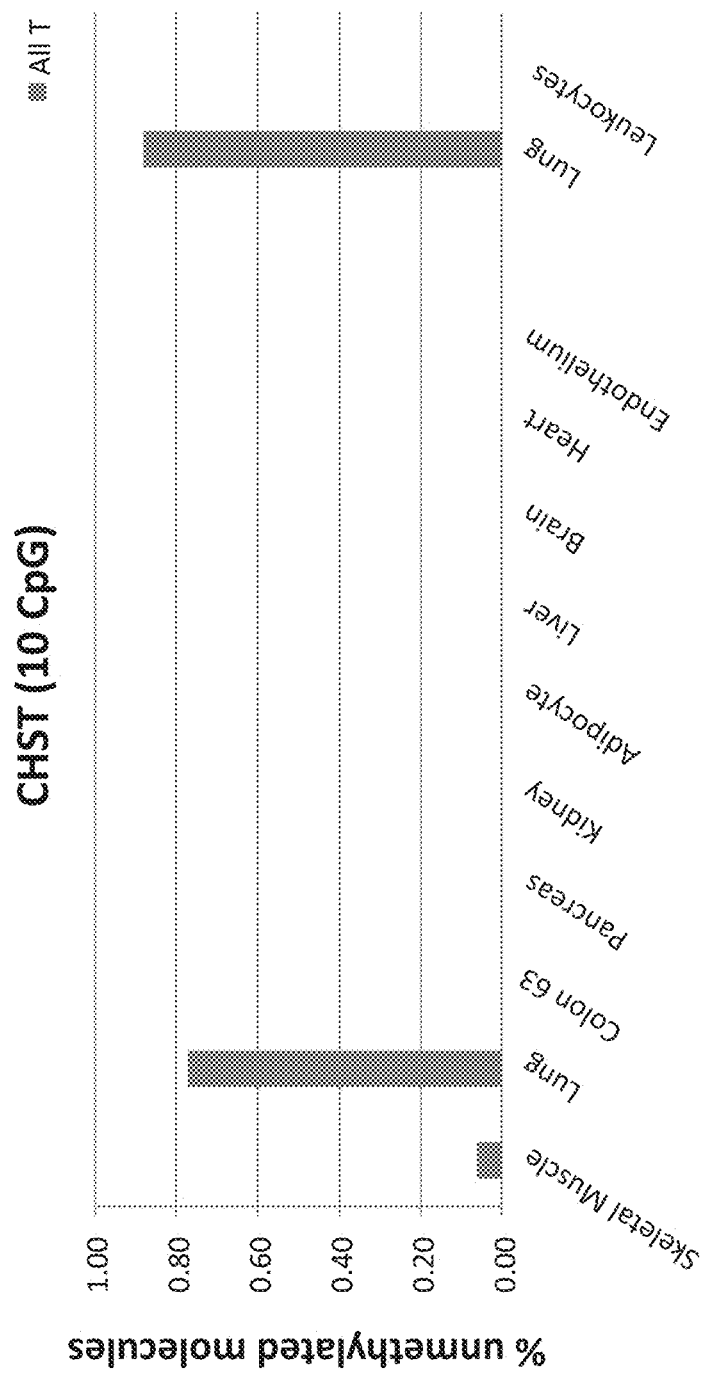

FIG. 18 is a graph illustrating the tissue distribution of unmethylated CHST (the sequence comprised in SEQ ID NO: 1272), a lung marker in various tissues.

Figure 19:
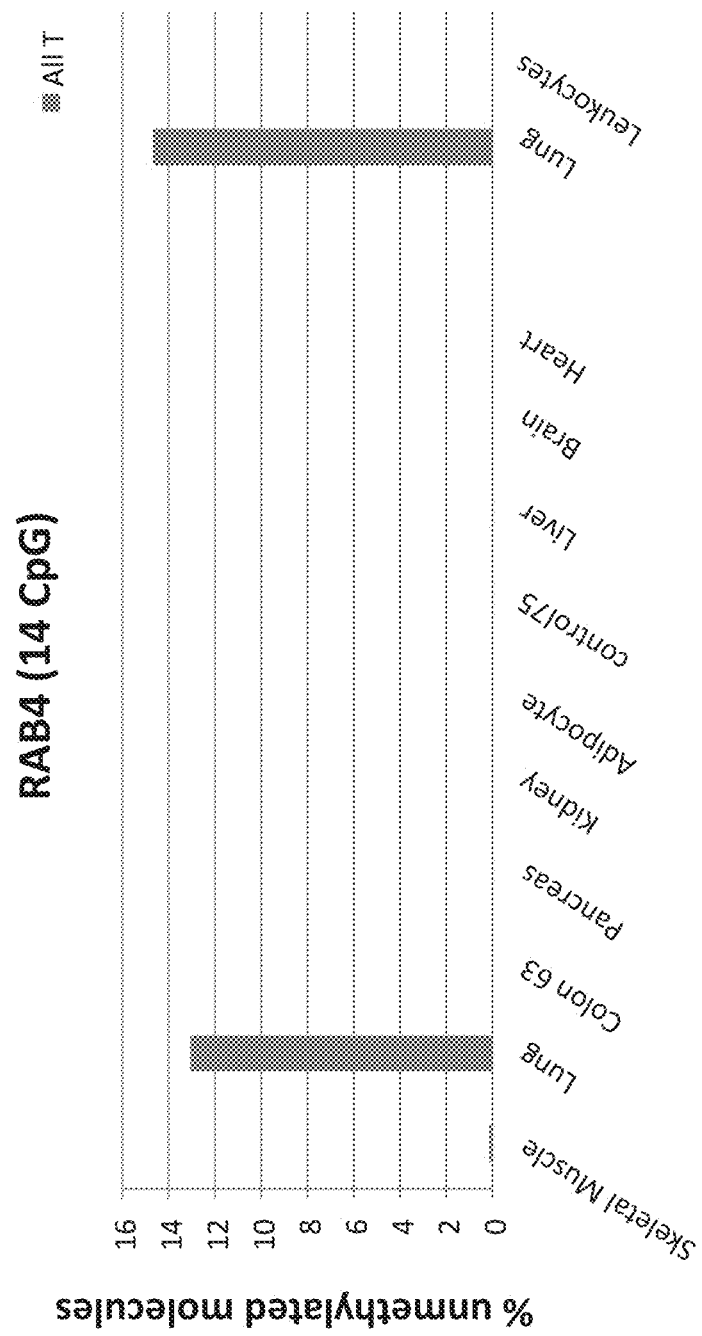

FIG. 19 is a graph illustrating the tissue distribution of unmethylated RAB4 (the sequence comprised in SEQ ID NO: 1271), a lung marker in various tissues.

FIGS. 20A-C are graphs illustrating the tissue distribution of three skeletal muscle markers (TNNI2, the sequence comprised in 1278, TPO, the sequence comprised in SEQ ID NO: 1277 and MAD1L1, the sequence comprised in SEQ ID NO: 1276), unmethylated in muscle and methylated elsewhere.

Figure 21:
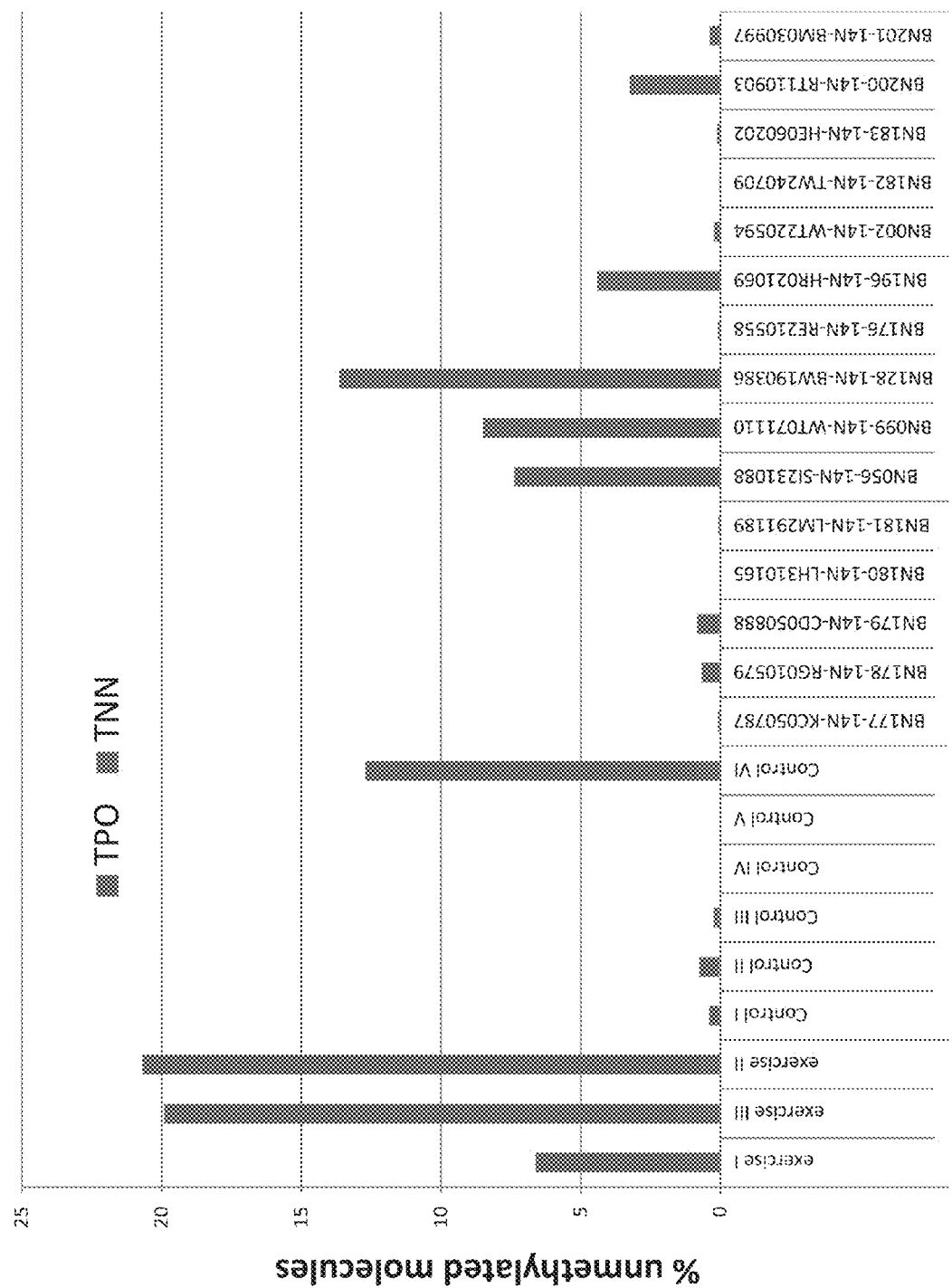

FIG. 21 is a graph illustrating the levels of skeletal muscle-derived DNA in plasma of healthy individuals after intensive exercise and in patients with Duchenne or Becker Muscular Dystrophy.

Figure 22:
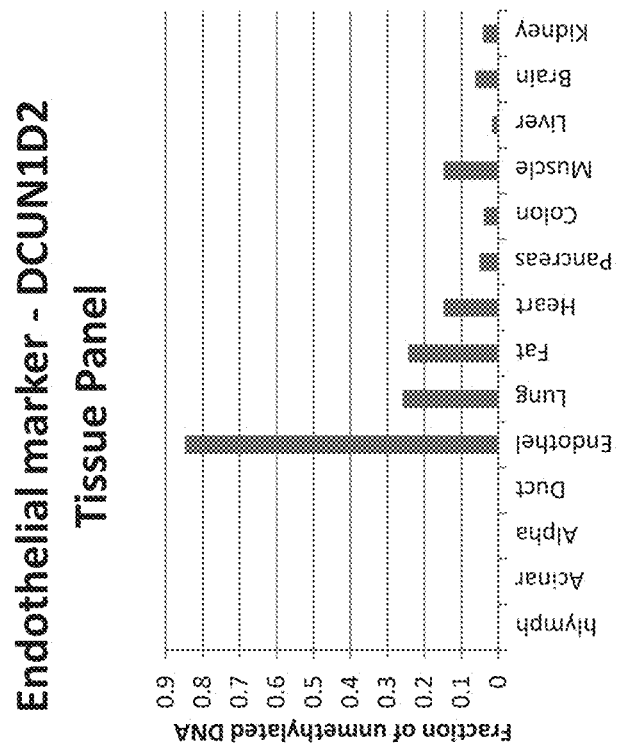

FIG. 22 is a graph illustrating the presence of a methylation marker of vascular endothelial cells (comprised in the sequence as set forth in SEQ ID NO: 1261 of the DCUN1D2 gene).

Figure 23:
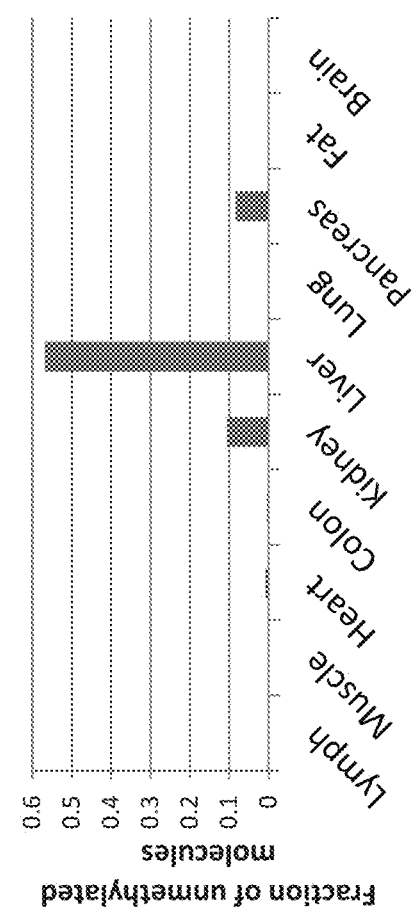

FIG. 23 is a graph illustrating the presence of a methylation marker of hepatocytes (comprised in the sequence as set forth in SEQ ID NO: 1267 of the ALB gene).

Figure 24A:
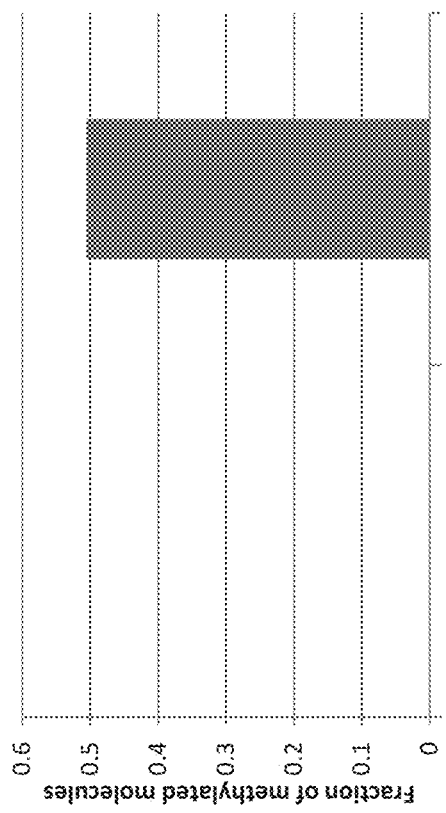
Figure 24B:
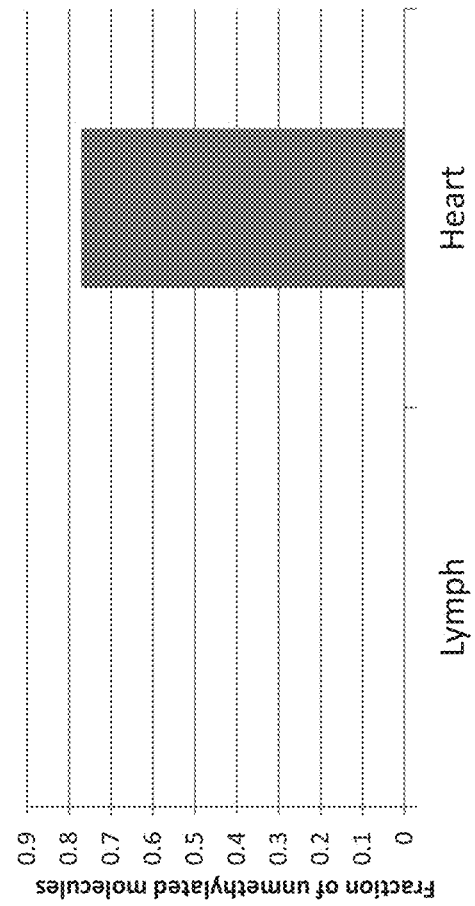

FIGS. 24A-B are graphs illustrating the presence of a methylation marker of lymphocytes (comprised in the sequence as set forth in SEQ ID NO: 1275 of the PTPRCAP gene and the sequence as set forth in SEQ ID NO: 1274 of the AGAP2 gene).

Figure 25:
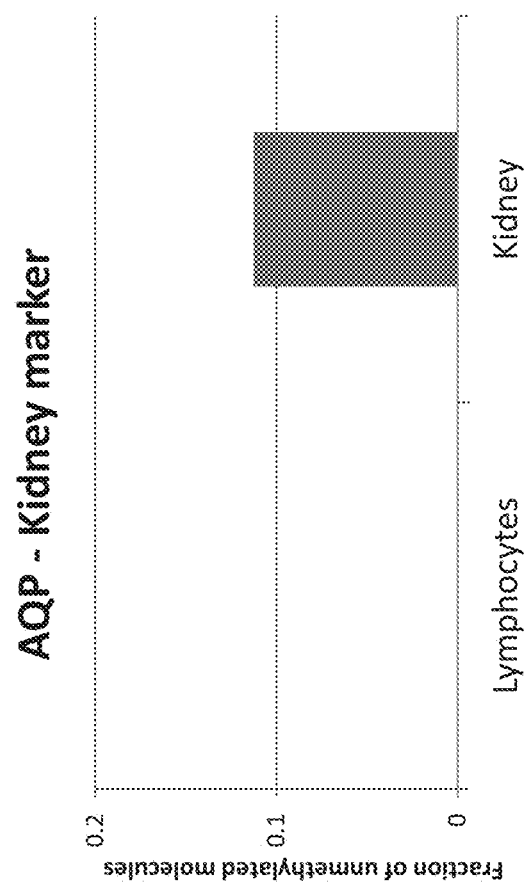
Figure 26A:
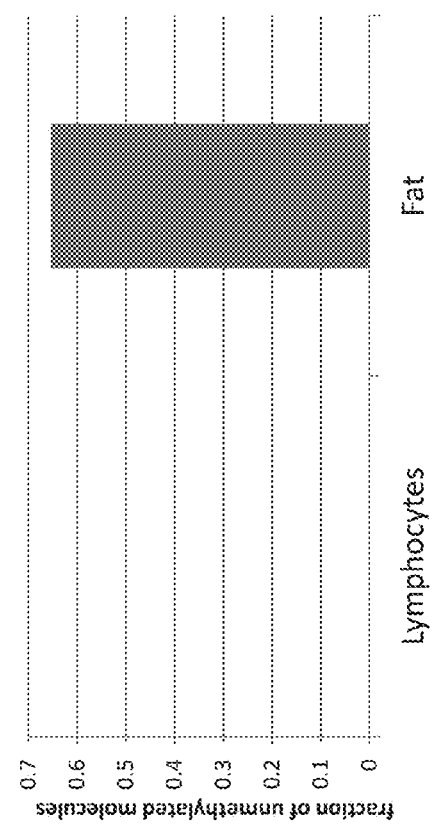
Figure 26B:
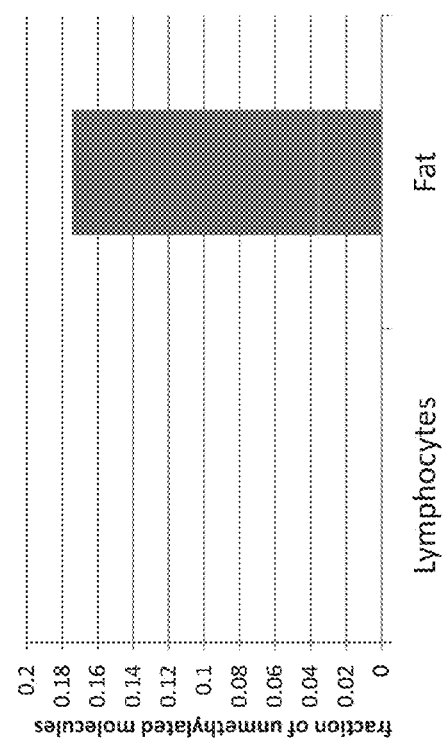
Figure 26C:
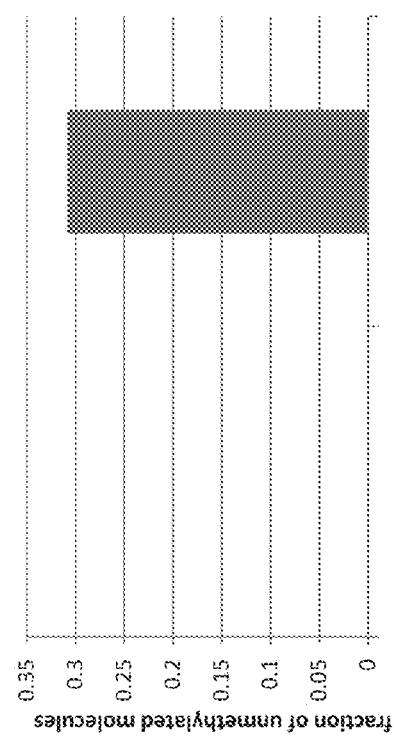
Figure 26D:
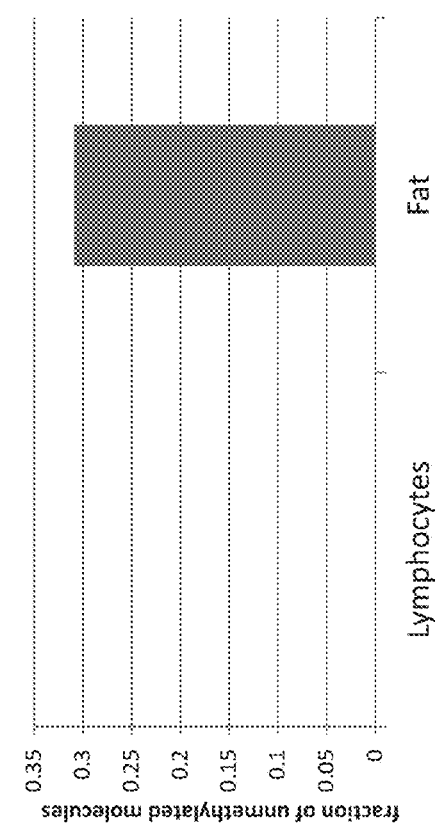

FIG. 25 is a graph illustrating the presence of a methylation marker of kidney (comprised in the sequence as set forth in SEQ ID NO: 1266 of the AQP2 gene).

FIGS. 26A-D are graphs illustrating the presence of methylation markers of adipocytes (comprised in the sequence as set forth in SEQ ID NO: 1262 of the ACOT7 gene, the sequence as set forth in SEQ ID NO: 1263 of the COL4A1 gene, the sequence as set forth in SEQ ID NO:

1264 of the FRMD4A gene, the sequence as set forth in SEQ ID NO: 1265 of the NNMT gene).

FIGS. 27A-D are graphs illustrating adipocyte-derived DNA in the circulation of healthy individuals (C-control).

DESCRIPTION OF SPECIFIC EMBODIMENTS OF THE INVENTION

The present invention, in some embodiments thereof, relates to a method of determining the source of cell-free DNA and use thereof for diagnosing pathological processes associated with cell death, monitoring therapeutic regimes such as drugs intended to change cell death and in studying for clinical and research purposes processes affecting cell death levels.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

The analysis of circulating DNA is beginning to revolutionize prenatal diagnosis, tumor diagnosis and the monitoring of graft rejection. However a major limitation of all applications is the dependence on the presence of identifiable genetic differences between the tissue of interest and the host. The present inventors have conceived of a novel approach for detecting the tissue origins of cell-free circulating DNA which overcomes this limitation.

The present inventors propose analysis of tissue-specific methylation patterns (comprising 4 or more methylation sites) present in circulating DNA fragments to provide a robust tool to non-invasively detect cell death in essentially every tissue of the human body. The present methods shows drastically reduced noise (level of signal in healthy individuals) compared with other approaches, to the degree that clinical utility can be envisaged.

Whilst reducing the present invention to practice, the present inventors detected circulating plasma DNA derived from specific human tissues in specific pathologies on the basis of analyzing such methylation patterns. Examples include the detection of circulating pancreatic beta cell DNA in type 1 diabetes (FIGS. 1A-D), exocrine pancreas DNA in pancreatic ductal adenocarcinoma and pancreatitis (FIGS. 4A-C), brain DNA after traumatic brain injury or an ischemic insult (FIGS. 3A-D), oligodendrocyte DNA in patients with relapsing multiple sclerosis (FIGS. 2A-C) and oligodendrocyte DNA and white matter DNA in patients with ALS (FIGS. 12 and 13). In addition, the present inventors detected colon DNA in blood of colon cancer and Crohn's disease patients, skeletal muscle DNA in blood of healthy individuals after exercise, adipocyte DNA in blood of healthy individuals, endothelial cell DNA in blood of cancer patients and oligodendrocyte DNA in blood of patients with glioblastoma multiforme.

The approach enables the detection, in a minimally invasive yet highly sensitive and specific manner, acute cell death in normal and pathologic human tissues. The potential utility of this approach is very broad. In the study of normal physiology, this method can be used to monitor tissue dynamics during development and during physiologic perturbations such as dietary changes, pregnancy and aging. In a wide variety of pathologies, including but not limited to cancers, trauma, infections and autoimmune diseases, the method can be used for early diagnosis, monitoring disease progression and assessment of response to therapy. In the setting of new drug development, the method can be adapted to identify signals of efficacy or toxicity, potentially streamlining the long and expensive process of drug development.

Thus, according to one aspect of the present invention there is provided a method of identifying a methylation signature for a cell type or tissue of interest comprising identifying in the DNA of the cell type or tissue of interest a continuous sequence of no more than 300 nucleotides which comprise at least 4 methylation sites, wherein each of the sites are differentially methylated with respect to a second non-identical cell, thereby identifying the methylation signature for the cell type or tissue of interest.

The present invention contemplates identifying methylation signatures in any cell of interest, including but not limited to pancreatic cells (such as pancreatic beta cells, exocrine pancreatic cells (e.g. acinar cells), brain cells, oligodendrocytes, cardiac cells (cardiomyocytes), liver cells (hepatocytes), kidney cells, vascular endothelial cells, lymphocytes, lung cells, a uterus cells, breast cells, adipocytes, colon cells, rectum cells, prostate cells, thyroid cells and skeletal muscle cells.

As used herein, the term "methylation site" refers to a cytosine residue adjacent to guanine residue (CpG site) that has a potential of being methylated.

The continuous sequence is preferably no longer than 300 nucleotides, 295 nucleotides, 290 nucleotides, 285 nucleotides, 280 nucleotides, 275 nucleotides, 270 nucleotides, 265 nucleotides, 260 nucleotides, 255 nucleotides, 250 nucleotides, 245 nucleotides, 240 nucleotides, 235 nucleotides, 230 nucleotides, 225 nucleotides, 220 nucleotides, 215 nucleotides, 210 nucleotides, 205 nucleotides, 200 nucleotides, 195 nucleotides, 190 nucleotides, 185 nucleotides, 180 nucleotides, 175 nucleotides, 170 nucleotides, 165 nucleotides, 160 nucleotides, 155 nucleotides, 150 nucleotides, 145 nucleotides, 140 nucleotides, 135 nucleotides, 130 nucleotides, 125 nucleotides, 120 nucleotides, 115 nucleotides, 110 nucleotides, 105 nucleotides, 100 nucleotides, 95 nucleotides, 90 nucleotides, 85 nucleotides, 80 nucleotides, 75 nucleotides, 70 nucleotides, 65 nucleotides, 60 nucleotides, 55 nucleotides, or 50 nucleotides.

According to a particular embodiment, the sequence is between 50-300 nucleotides, e.g. between 50-250, between 50-200, between 100-300 nucleotides, or between 100-250 nucleotides.

The sequence may be of a coding or non-coding region.

According to a particular embodiment, the sequence is not derived from a gene which is differentially expressed in the cell of interest. Thus, for example in the case of identifying a methylation pattern for a pancreatic beta cell, the DNA sequence may not be part of a gene encoding insulin or another pancreatic beta cell protein.

In accordance with another particular embodiment, the methylation pattern characterizes the normal cell of interest and is not a methylation pattern characterizing a diseased cell (is not for example a methylation pattern characterizing cancer cells of a specific type).

The continuous nucleic acid sequences comprise at least 4 methylation sites, although at least 5, at least 6, at least 7 at least 8, at least 9 or even at least 10 or more methylation sites are contemplated.

In order to be considered a methylation signature for a particular cell of interest each of the at least four methylation sites have to be differentially methylated in that cell of interest with respect to a second non-identical cell.

According to a particular embodiment, each of the at least four methylation sites are unmethylated in the cell of interest (the cell for which the methylation pattern is being determined), whereas in the second non-identical cell each of the sites are methylated.

According to another embodiment, each of the at least four methylation sites are methylated in the cell of interest, whereas in the second non-identical cell each of the sites are unmethylated.

According to another embodiment, at least one of the four methylation sites is unmethylated in the cell of interest, whereas in the second non-identical cell that site is methylated.

According to another embodiment, at least two of the four methylation sites are unmethylated in the cell of interest, whereas in the second non-identical cell those sites are methylated.

According to another embodiment, at least three of the four methylation sites are unmethylated in the cell of interest, whereas in the second non-identical cell those sites are methylated.

The second non-identical cell may be of any source including for example blood cells.

Using this method, the present inventors have identified methylation signatures of DNA derived from pancreatic beta cells, acinar cells, brain cells, neurons, oligodendrocytes, cardiomyocytes, hepatocytes, kidney cells and skeletal muscle cells and show that these signatures can successfully distinguish between DNA derived from those cells and DNA derived from blood cells.

Thus, according to another aspect of the present invention there is provided a method of determining whether DNA is derived from a cell of interest in a sample, the method comprising:

determining the methylation status of at least four methylation sites on a continuous sequence of the DNA, the sequence comprising no more than 300 nucleotides, wherein a methylation status of each of the at least four methylation sites on the continuous sequence characteristic of the cell of interest, is indicative that the DNA is derived from the cell of interest.

It will be appreciated that the method is appropriate for examining if the investigated DNA is derived from a particular cell type or tissue type since the sequences analyzed are specific for particular cell/tissue types.

Thus, for example if the investigator wishes to determine if the DNA present in a sample is derived from pancreatic beta cells, he/she needs to analyze sequences which have a methylation pattern characteristic of pancreatic beta cells.

Such sequences are comprised for example in sequences as set forth in SEQ ID NOs: 1-50 and 1241-1244.

SEQ ID NOs: 1-27 and 1241-1244 comprise sequences which include at least 4 methylation sites in a continuous sequence of no more than 300 nucleotides that are unmethylated in pancreatic beta cells and methylated in other cells (e.g. blood cells). According to a particular embodiment, the continuous sequence comprises the nucleotides CG which are at position 250 and 251 of each of these sequences. This CG is unmethylated in pancreatic beta cells and methylated in other cells (e.g. blood cells).

SEQ ID NOs: 28-50 comprise sequences which include at least 4 methylation sites in a continuous sequence of no more than 300 nucleotides that are methylated in pancreatic beta cells and unmethylated in other cells (e.g. blood cells). According to a particular embodiment, the continuous sequence comprises the nucleotides CG which are at position 250 and 251 of each of these sequences. This CG is methylated in pancreatic beta cells and unmethylated in other cells (e.g. blood cells).

If the investigator wishes to determine if the DNA present in a sample is derived from pancreatic ductal cells, he/she needs to analyze sequences which have a methylation pattern characteristic of ductal cells.

Such sequences are comprised for example in sequences as set forth in SEQ ID NOs: 51-150.

SEQ ID NOs: 51-100 comprise sequences which include at least 4 methylation sites in a continuous sequence of no more than 300 nucleotides that are unmethylated in pancreatic ductal cells and methylated in other cells (e.g. blood cells). According to a particular embodiment, the continuous sequence comprises the nucleotides CG which are at position 250 and 251 of each of these sequences. This CG is unmethylated in pancreatic ductal cells and methylated in other cells (e.g. blood cells).

SEQ ID NOs: 101-150 comprise sequences which include at least 4 methylation sites in a continuous sequence of no more than 300 nucleotides that are methylated in pancreatic ductal cells and unmethylated in other cells (e.g. blood cells). According to a particular embodiment, the continuous sequence comprises the nucleotides CG which are at position 250 and 251 of each of these sequences. This CG is methylated in pancreatic ductal cells and unmethylated in other cells (e.g. blood cells).

If the investigator wishes to determine if the DNA present in a sample is derived from liver cells, he/she needs to analyze sequences which have a methylation pattern characteristic of liver cells.

Such sequences are comprised for example in sequences as set forth in SEQ ID NOs: 151-197 and 1267.

SEQ ID NOs: 151-173 and 1267 comprise sequences which include at least 4 methylation sites in a continuous sequence of no more than 300 nucleotides that are unmethylated in liver cells and methylated in other cells (e.g. blood cells). According to a particular embodiment, the continuous sequence comprises the nucleotides CG which are at position 250 and 251 of each of these sequences. This CG is unmethylated in liver cells and methylated in other cells (e.g. blood cells).

SEQ ID NOs: 174-197 comprise sequences which include at least 4 methylation sites in a continuous sequence of no more than 300 nucleotides that are methylated in liver cells and unmethylated in other cells (e.g. blood cells). According to a particular embodiment, the continuous sequence comprises the nucleotides CG which are at position 250 and 251 of each of these sequences. This CG is methylated in liver cells and unmethylated in other cells (e.g. blood cells).

If the investigator wishes to determine if the DNA present in a sample is derived from lung tissue, he/she needs to analyze sequences which have a methylation pattern characteristic of lung cells.

Such sequences are comprised for example in sequences 198-203 and 1268-1273.

SEQ ID NOs: 198-200 and 1268-1273 comprise sequences which include at least 4 methylation sites in a continuous sequence of no more than 300 nucleotides that are unmethylated in lung cells and methylated in other cells (e.g. blood cells). According to a particular embodiment, the continuous sequence comprises the nucleotides CG which are at position 250 and 251 of each of these sequences. This CG is unmethylated in lung cells and methylated in other cells (e.g. blood cells).

SEQ ID NOs: 201-203 comprise sequences which include at least 4 methylation sites in a continuous sequence of no more than 300 nucleotides that are methylated in lung cells and unmethylated in other cells (e.g. blood cells). According to a particular embodiment, the continuous sequence comprises the nucleotides CG which are at position 250 and 251 of each of these sequences. This CG is methylated in lung cells and unmethylated in other cells (e.g. blood cells).

If the investigator wishes to determine if the DNA present in a sample is derived from uterine tissue, he/she needs to analyze sequences which have a methylation pattern characteristic of uterus cells.

Such sequences are comprised for example in sequences 204-237.

SEQ ID NOs: 204-227 comprise sequences which include at least 4 methylation sites in a continuous sequence of no more than 300 nucleotides that are unmethylated in uterus cells and methylated in other cells (e.g. blood cells). According to a particular embodiment, the continuous sequence comprises the nucleotides CG which are at position 250 and 251 of each of these sequences. This CG is unmethylated in uterus cells and methylated in other cells (e.g. blood cells).

SEQ ID NOs: 228-237 comprise sequences which include at least 4 methylation sites in a continuous sequence of no more than 300 nucleotides that are methylated in uterus cells and unmethylated in other cells (e.g. blood cells). According to a particular embodiment, the continuous sequence comprises the nucleotides CG which are at position 250 and 251 of each of these sequences. This CG is methylated in uterus cells and unmethylated in other cells (e.g. blood cells).

If the investigator wishes to determine if the DNA present in a sample is derived from kidney cells, he/she needs to analyze sequences which have a methylation pattern characteristic of kidney cells.

Such sequences are comprised for example in sequences 238-273 and 1266.

SEQ ID NOs: 238-254 and 1266 comprise sequences which include at least 4 methylation sites in a continuous sequence of no more than 300 nucleotides that are unmethylated in kidney cells and methylated in other cells (e.g. blood cells). According to a particular embodiment, the continuous sequence comprises the nucleotides CG which are at position 250 and 251 of each of these sequences. This CG is unmethylated in kidney cells and methylated in other cells (e.g. blood cells).

SEQ ID NOs: 255-273 comprise sequences which include at least 4 methylation sites in a continuous sequence of no more than 300 nucleotides that are methylated in kidney cells and unmethylated in other cells (e.g. blood cells). According to a particular embodiment, the continuous sequence comprises the nucleotides CG which are at position 250 and 251 of each of these sequences. This CG is methylated in kidney cells and unmethylated in other cells (e.g. blood cells).

If the investigator wishes to determine if the DNA present in a sample is derived from breast tissue, he/she needs to analyze sequences which have a methylation pattern characteristic of breast cells.

Such sequences are comprised for example in sequences 274-290.

SEQ ID NOs: 274-277 comprise sequences which include at least 4 methylation sites in a continuous sequence of no more than 300 nucleotides that are unmethylated in breast tissue and methylated in other cells of non-breast tissue (e.g. blood cells). According to a particular embodiment, the continuous sequence comprises the nucleotides CG which are at position 250 and 251 of each of these sequences. This CG is unmethylated in breast cells and methylated in cells of non-breast tissue (e.g. blood cells).

SEQ ID NOs: 278-290 comprise sequences which include at least 4 methylation sites in a continuous sequence of no more than 300 nucleotides that are methylated in breast tissue and unmethylated in cells of non-breast tissue (e.g. blood cells). According to a particular embodiment, the continuous sequence comprises the nucleotides CG which are at position 250 and 251 of each of these sequences. This CG is methylated in breast tissue and unmethylated in cells of non-breast tissue (e.g. blood cells).

If the investigator wishes to determine if the DNA present in a sample is derived from adipocytes, he/she needs to analyze sequences which have a methylation pattern characteristic of adipocytes.

Such sequences are comprised for example in sequences as set forth in SEQ ID NOs: 291-338 and 1262-1265.

SEQ ID NOs: 291-337 and 1262-1265 comprise sequences which include at least 4 methylation sites in a continuous sequence of no more than 300 nucleotides that are unmethylated in adipocytes and methylated in other cells (e.g. blood cells). According to a particular embodiment, the continuous sequence comprises the nucleotides CG which are at position 250 and 251 of each of these sequences. This CG is unmethylated in adipocytes and methylated in other cells (e.g. blood cells).

SEQ ID NO: 338 comprise sequences which include at least 4 methylation sites in a continuous sequence of no more than 300 nucleotides that are methylated in adipocytes and unmethylated in other cells (e.g. blood cells). According to a particular embodiment, the continuous sequence comprises the nucleotides CG which are at position 250 and 251 of this sequence. This CG is methylated in adipocytes and unmethylated in other cells (e.g. blood cells).

If the investigator wishes to determine if the DNA present in a sample is derived from colon tissue, he/she needs to analyze sequences which have a methylation pattern characteristic of cells derived from colon tissue.

Such sequences are comprised for example in sequences as set forth in SEQ ID NOs: 339-377 and 1257-1260.

SEQ ID NOs: 339-351 and 1257-1260 comprise sequences which include at least 4 methylation sites in a continuous sequence of no more than 300 nucleotides that are unmethylated in cells of colon tissue and methylated in other cells of non-colon tissue (e.g. blood cells). According to a particular embodiment, the continuous sequence comprises the nucleotides CG which are at position 250 and 251 of each of these sequences. This CG is unmethylated in colon cells and methylated in cells of non-colon tissue (e.g. blood cells).

SEQ ID NOs: 352-377 comprise sequences which include at least 4 methylation sites in a continuous sequence of no more than 300 nucleotides that are methylated in colon tissue and unmethylated in cells of non-colon tissue (e.g. blood cells). According to a particular embodiment, the continuous sequence comprises the nucleotides CG which are at position 250 and 251 of each of these sequences. This CG is methylated in colon tissue and unmethylated in cells of non-colon tissue (e.g. blood cells).

If the investigator wishes to determine if the DNA present in a sample is derived from prostate tissue cells, he/she needs to analyze sequences which have a methylation pattern characteristic of prostate tissue cells.

Such sequences are comprised for example in sequences 378-443.

SEQ ID NOs: 378-409 comprise sequences which include at least 4 methylation sites in a continuous sequence of no more than 300 nucleotides that are unmethylated in prostate tissue and methylated in other cells of non-prostate tissue (e.g. blood cells). According to a particular embodiment, the continuous sequence comprises the nucleotides CG which are at position 250 and 251 of each of these sequences. This CG is unmethylated in prostate cells and methylated in cells of non-prostate tissue (e.g. blood cells).

SEQ ID NOs: 410-443 comprise sequences which include at least 4 methylation sites in a continuous sequence of no more than 300 nucleotides that are methylated in prostate tissue and unmethylated in cells of non-prostate tissue (e.g. blood cells). According to a particular embodiment, the continuous sequence comprises the nucleotides CG which are at position 250 and 251 of each of these sequences. This CG is methylated in prostate tissue and unmethylated in cells of non-prostate tissue (e.g. blood cells).

If the investigator wishes to determine if the DNA present in a sample is derived from thyroid tissue cells, he/she needs to analyze sequences which have a methylation pattern characteristic of thyroid tissue cells.

Such sequences are comprised for example in sequences 444-501.

SEQ ID NOs: 444-455 comprise sequences which include at least 4 methylation sites in a continuous sequence of no more than 300 nucleotides that are unmethylated in thyroid tissue and methylated in other cells of non-thyroid tissue (e.g. blood cells). According to a particular embodiment, the continuous sequence comprises the nucleotides CG which are at position 250 and 251 of each of these sequences. This CG is unmethylated in thyroid cells and methylated in cells of non-thyroid tissue (e.g. blood cells).

SEQ ID NOs: 456-501 comprise sequences which include at least 4 methylation sites in a continuous sequence of no more than 300 nucleotides that are methylated in thyroid tissue and unmethylated in cells of non-thyroid tissue (e.g. blood cells). According to a particular embodiment, the continuous sequence comprises the nucleotides CG which are at position 250 and 251 of each of these sequences. This CG is methylated in thyroid tissue and unmethylated in cells of non-thyroid tissue (e.g. blood cells).

If the investigator wishes to determine if the DNA present in a sample is derived from bladder tissue cells, he/she needs to analyze sequences which have a methylation pattern characteristic of bladder tissue cells.

Such sequences are comprised for example in sequences 502-509.

SEQ ID NOs: 502-506 comprise sequences which include at least 4 methylation sites in a continuous sequence of no more than 300 nucleotides that are unmethylated in bladder tissue and methylated in other cells of non-bladder tissue (e.g. blood cells). According to a particular embodiment, the continuous sequence comprises the nucleotides CG which are at position 250 and 251 of each of these sequences. This CG is unmethylated in bladder cells and methylated in cells of non-bladder tissue (e.g. blood cells).

SEQ ID NOs: 507-509 comprise sequences which include at least 4 methylation sites in a continuous sequence of no more than 300 nucleotides that are methylated in bladder tissue and unmethylated in cells of non-bladder tissue (e.g. blood cells). According to a particular embodiment, the continuous sequence comprises the nucleotides CG which are at position 250 and 251 of each of these sequences. This CG is methylated in bladder tissue and unmethylated in cells of non-bladder tissue (e.g. blood cells).

If the investigator wishes to determine if the DNA present in a sample is derived from islets, he/she needs to analyze sequences which have a methylation pattern characteristic of islets.

Such sequences are comprised for example in sequences 510-746.

SEQ ID NOs: 510-650 comprise sequences which include at least 4 methylation sites in a continuous sequence of no more than 300 nucleotides that are unmethylated in islets and methylated in cells of non-islet tissue (e.g. blood cells). According to a particular embodiment, the continuous sequence comprises the nucleotides CG which are at position 250 and 251 of each of these sequences. This CG is unmethylated in islets and methylated in cells of non-islet tissue (e.g. blood cells).

SEQ ID NOs: 651-746 comprise sequences which include at least 4 methylation sites in a continuous sequence of no more than 300 nucleotides that are methylated in islets and unmethylated in cells of non-islet tissue (e.g. blood cells). According to a particular embodiment, the continuous sequence comprises the nucleotides CG which are at position 250 and 251 of each of these sequences. This CG is methylated in islets and unmethylated in cells of non-islet tissue (e.g. blood cells).

If the investigator wishes to determine if the DNA present in a sample is derived from skeletal muscle, he/she needs to analyze sequences which have a methylation pattern characteristic of skeletal muscle.

Such sequences are comprised for example in sequences 747-817 and 1276-1279.

SEQ ID NOs: 747-767 and 1276-1279 comprise sequences which include at least 4 methylation sites in a continuous sequence of no more than 300 nucleotides that are unmethylated in skeletal muscle and methylated in cells of non-skeletal muscle tissue (e.g. blood cells). According to a particular embodiment, the continuous sequence comprises the nucleotides CG which are at position 250 and 251 of each of these sequences. This CG is unmethylated in skeletal muscle and methylated in cells of non-skeletal muscle tissue (e.g. blood cells).

SEQ ID NOs: 768-817 comprise sequences which include at least 4 methylation sites in a continuous sequence of no more than 300 nucleotides that are methylated in skeletal muscle and unmethylated in cells of non-skeletal muscle tissue (e.g. blood cells). According to a particular embodiment, the continuous sequence comprises the nucleotides CG which are at position 250 and 251 of each of these sequences. This CG is methylated in islets and unmethylated in cells of non-skeletal muscle tissue (e.g. blood cells).

If the investigator wishes to determine if the DNA present in a sample is derived from pancreatic tissue, he/she needs to analyze sequences which have a methylation pattern characteristic of pancreatic tissue.

Such sequences are comprised for example in sequences 818-863 and 1280-1284.

SEQ ID NOs: 818-835 and 1280-1284 comprise sequences which include at least 4 methylation sites in a continuous sequence of no more than 300 nucleotides that are unmethylated in pancreatic tissue and methylated in cells of non-pancreatic tissue (e.g. blood cells). According to a particular embodiment, the continuous sequence comprises the nucleotides CG which are at position 250 and 251 of each of these sequences. This CG is unmethylated in pancreatic tissue and methylated in cells of non-pancreatic tissue (e.g. blood cells).

SEQ ID NOs: 836-863 comprise sequences which include at least 4 methylation sites in a continuous sequence of no more than 300 nucleotides that are methylated in pancreatic and unmethylated in cells of non-pancreatic tissue (e.g. blood cells).

According to a particular embodiment, the continuous sequence comprises the nucleotides CG which are at position 250 and 251 of each of these sequences. This CG is methylated in pancreatic tissue and unmethylated in cells of non-pancreatic tissue (e.g. blood cells).

If the investigator wishes to determine if the DNA present in a sample is derived from brain white matter tissue, he/she needs to analyze sequences which have a methylation pattern characteristic of brain white matter tissue.

Such sequences are comprised for example in sequences 864-1012.

SEQ ID NOs: 864-963 comprise sequences which include at least 4 methylation sites in a continuous sequence of no more than 300 nucleotides that are unmethylated in brain white matter tissue and methylated in cells of non-brain white matter tissue (e.g. blood cells). According to a particular embodiment, the continuous sequence comprises the nucleotides CG which are at position 250 and 251 of each of these sequences. This CG is unmethylated in white matter tissue and methylated in cells of non-white matter tissue (e.g. blood cells).

SEQ ID NOs: 964-1012 comprise sequences which include at least 4 methylation sites in a continuous sequence of no more than 300 nucleotides that are methylated in white matter tissue and unmethylated in cells of non-white matter tissue (e.g. blood cells). According to a particular embodiment, the continuous sequence comprises the nucleotides CG which are at position 250 and 251 of each of these sequences. This CG is methylated in white matter tissue and unmethylated in cells of non-white matter tissue (e.g. blood cells).

If the investigator wishes to determine if the DNA present in a sample is derived from blood cells, he/she needs to analyze sequences which have a methylation pattern characteristic of blood cells.

Such sequences are comprised for example in sequences 1013-1137 and 1274-1275.

SEQ ID NOs: 1013-1112 and 1274-1275 comprise sequences which include at least 4 methylation sites in a continuous sequence of no more than 300 nucleotides that are unmethylated in blood cells and methylated in non-blood cells. According to a particular embodiment, the continuous sequence comprises the nucleotides CG which are at position 250 and 251 of each of these sequences. This CG is unmethylated in blood cells and methylated in non blood cells.

SEQ ID NOs: 1113-1137 comprise sequences which include at least 4 methylation sites in a continuous sequence of no more than 300 nucleotides that are methylated in blood cells and unmethylated in non blood cells. According to a particular embodiment, the continuous sequence comprises the nucleotides CG which are at position 250 and 251 of each of these sequences. This CG is methylated in blood cells and unmethylated in non blood cells.

If the investigator wishes to determine if the DNA present in a sample is derived from cervical tissue, he/she needs to analyze sequences which have a methylation pattern characteristic of cervical cells.

Such sequences are comprised for example in sequences 1138-1216.

SEQ ID NOs: 1138-1173 comprise sequences which include at least 4 methylation sites in a continuous sequence of no more than 300 nucleotides that are unmethylated in cervical tissue cells and methylated in non-cervical tissue cells. According to a particular embodiment, the continuous sequence comprises the nucleotides CG which are at position 250 and 251 of each of these sequences. This CG is unmethylated in cervical cells and methylated in non-cervical tissue cells.

SEQ ID NOs: 1174-1216 comprise sequences which include at least 4 methylation sites in a continuous sequence of no more than 300 nucleotides that are methylated in cervical tissue cells and unmethylated in non cervical tissue cells. According to a particular embodiment, the continuous sequence comprises the nucleotides CG which are at position 250 and 251 of each of these sequences. This CG is methylated in cervical tissue cells and unmethylated in non cervical tissue cells.

If the investigator wishes to determine if the DNA present in a sample is derived from retinal tissue, he/she needs to analyze sequences which have a methylation pattern characteristic of retinal cells.

Such sequences are comprised for example in sequences 1217-1240.

SEQ ID NOs: 1217-1240 comprise sequences which include at least 4 methylation sites in a continuous sequence of no more than 300 nucleotides that are unmethylated in retinal tissue cells and methylated in non-retinal tissue cells. According to a particular embodiment, the continuous sequence comprises the nucleotides CG which are at position 250 and 251 of each of these sequences. This CG is unmethylated in retinal cells and methylated in non-retinal tissue cells (e.g. blood cells).

If the investigator wishes to determine if the DNA present in a sample is derived from brain tissue, he/she needs to analyze sequences which have a methylation pattern characteristic of brain tissue cells.

Such sequences are comprised for example in sequences 1285-1364 and 1245-1256.

SEQ ID NOs: 1245-1256 and 1285-1316 comprise sequences which include at least 4 methylation sites in a continuous sequence of no more than 300 nucleotides that are unmethylated in brain tissue cells and methylated in non-brain tissue cells. According to a particular embodiment, the continuous sequence comprises the nucleotides CG which are at position 250 and 251 of each of these sequences. This CG is unmethylated in brain cells and methylated in non-brain tissue cells (e.g. blood cells).

SEQ ID NOs: 1317-1364 comprise sequences which include at least 4 methylation sites in a continuous sequence of no more than 300 nucleotides that are methylated in brain tissue cells and unmethylated in non brain tissue cells (e.g. blood cells). According to a particular embodiment, the continuous sequence comprises the nucleotides CG which are at position 250 and 251 of each of these sequences. This CG is methylated in brain tissue cells and unmethylated in non-brain tissue cells (e.g. blood cells).

If the investigator wishes to determine if the DNA present in a sample is derived from rectal tissue, he/she needs to analyze sequences which have a methylation pattern characteristic of rectal tissue cells.

Such sequences are comprised for example in sequences as set forth in SEQ ID NOs: 1365-1385.

SEQ ID NOs: 1365-1373 comprise sequences which include at least 4 methylation sites in a continuous sequence of no more than 300 nucleotides that are unmethylated in rectal tissue cells and methylated in other cells (e.g. blood cells). According to a particular embodiment, the continuous sequence comprises the nucleotides CG which are at position 250 and 251 of each of these sequences. This CG is unmethylated in rectal tissue cells and methylated in other cells (e.g. blood cells).

SEQ ID NOs: 1374-1385 comprise sequences which include at least 4 methylation sites in a continuous sequence of no more than 300 nucleotides that are methylated in rectal tissue cells and unmethylated in other cells (e.g. blood cells). According to a particular embodiment, the continuous sequence comprises the nucleotides CG which are at position 250 and 251 of each of these sequences. This CG is methylated in rectal tissue cells and unmethylated in other cells (e.g. blood cells).

If the investigator wishes to determine if the DNA present in a sample is derived from cardiac tissue, he/she needs to analyze sequences which have a methylation pattern characteristic of cardiac tissue cells.

Such sequences are comprised for example in sequences as set forth in SEQ ID NOs: 1386-1484.

SEQ ID NOs: 1386-1435 comprise sequences which include at least 4 methylation sites in a continuous sequence of no more than 300 nucleotides that are unmethylated in cardiac tissue cells and methylated in other cells (e.g. blood cells). According to a particular embodiment, the continuous sequence comprises the nucleotides CG which are at position 250 and 251 of each of these sequences. This CG is unmethylated in cardiac tissue cells and methylated in other cells (e.g. blood cells).

SEQ ID NOs: 1436-1484 comprise sequences which include at least 4 methylation sites in a continuous sequence of no more than 300 nucleotides that are methylated in cardiac tissue cells and unmethylated in other cells (e.g. blood cells). According to a particular embodiment, the continuous sequence comprises the nucleotides CG which are at position 250 and 251 of each of these sequences. This CG is methylated in cardiac tissue cells and unmethylated in other cells (e.g. blood cells).

The sequences which have been identified by the present inventors as being candidates for determining the cellular source of a DNA may be stored in a database. Exemplary sequences include those described herein above—such as those set forth in SEQ ID NOs: 1-1484.

The database may be divided into sequences which are relevant for identification of a particular cell type or tissue source. Additionally, or alternatively, the database may be divided into sequences which when non-methylated are indicative of a particular cell type/tissue source and into sequences which, when methylated are indicative of a particular cell type/tissue source.

The database may also contain the methylation status of the sequences in subjects which have been tested. The subjects may be classified as being healthy or diseased.

The database may be stored in a computer readable format on a computer readable medium, and is optionally and preferably accessed by a data processor, such as a general purpose computer or dedicated circuitry.

Samples which may be analyzed are generally fluid samples derived from mammalian subjects and include for example blood, plasma, sperm, milk, urine, saliva or cerebral spinal fluid.

Samples which are analyzed typically comprise DNA from at least two cell/tissue sources, as further described herein below.

According to one embodiment, a sample of blood is obtained from a subject according to methods well known in the art. Plasma or serum may be isolated according to methods known in the art.

DNA may be isolated from the blood immediately or within 1 hour, 2 hours, 3 hours, 4 hours, 5 hours or 6 hours. Optionally the blood is stored at temperatures such as 4° C., or at −20° C. prior to isolation of the DNA. In some embodiments, a portion of the blood sample is used in accordance with the invention at a first instance of time whereas one or more remaining portions of the blood sample (or fractions thereof) are stored for a period of time for later use.

According to one embodiment, the DNA is cellular DNA (i.e. comprised in a cell).

According to still another embodiment, the DNA is comprised in a shedded cell or non-intact cell.

Methods of DNA extraction are well-known in the art. A classical DNA isolation protocol is based on extraction using organic solvents such as a mixture of phenol and chloroform, followed by precipitation with ethanol (J. Sambrook et al., "Molecular Cloning: A Laboratory Manual", 1989, $2^{nd}$ Ed., Cold Spring Harbour Laboratory Press: New York, N.Y.). Other methods include: salting out DNA extraction (P. Sunnucks et al., Genetics, 1996, 144: 747-756; S. M. Aljanabi and I. Martinez, Nucl. Acids Res. 1997, 25: 4692-4693), trimethylammonium bromide salts DNA extraction (S. Gustincich et al., BioTechniques, 1991, 11: 298-302) and guanidinium thiocyanate DNA extraction (J. B. W. Hammond et al., Biochemistry, 1996, 240: 298-300).

There are also numerous versatile kits that can be used to extract DNA from tissues and bodily fluids and that are commercially available from, for example, BD Biosciences Clontech (Palo Alto, Calif.), Epicentre Technologies (Madison, Wis.), Gentra Systems, Inc. (Minneapolis, Minn.), MicroProbe Corp. (Bothell, Wash.), Organon Teknika (Durham, N.C.), and Qiagen Inc. (Valencia, Calif.). User Guides that describe in great detail the protocol to be followed are usually included in all these kits. Sensitivity, processing time and cost may be different from one kit to another. One of ordinary skill in the art can easily select the kit(s) most appropriate for a particular situation.

According to another embodiment, the DNA is cell-free DNA. For this method, cell lysis is not performed on the sample. Methods of isolating cell-free DNA from body fluids are also known in the art. For example Qiaquick kit, manufactured by Qiagen may be used to extract cell-free DNA from plasma or serum.

The sample may be processed before the method is carried out, for example DNA purification may be carried out following the extraction procedure. The DNA in the sample may be cleaved either physically or chemically (e.g. using a suitable enzyme). Processing of the sample may involve one or more of: filtration, distillation, centrifugation, extraction, concentration, dilution, purification, inactivation of interfering components, addition of reagents, and the like.

It will be appreciated that the present invention contemplates analyzing more than one target sequence (each one comprising at least four methylation sites on a continuous sequence of the DNA). Thus, for example 2, 3, 4, 5, 6, 7, 8, 9, 10 or more target sequences (serving as tissue or cell-specific markers) may be analyzed. This may be effected in parallel using the same DNA preparation or on a plurality of DNA preparations.

Methods of determining the methylation status of a methylation site are known in the art and include the use of bisulfite.

In this method, DNA is treated with bisulfite which converts cytosine residues to uracil (which are converted to thymidine following PCR), but leaves 5-methylcytosine residues unaffected. Thus, bisulfite treatment introduces specific changes in the DNA sequence that depend on the methylation status of individual cytosine residues, yielding single-nucleotide resolution information about the methylation status of a segment of DNA. Various analyses can be performed on the altered sequence to retrieve this information. The objective of this analysis is therefore reduced to differentiating between single nucleotide polymorphisms (cytosines and thymidine) resulting from bisulfite conversion.

During the bisulfite reaction, care should be taken to minimize DNA degradation, such as cycling the incubation temperature.

Bisulfite sequencing relies on the conversion of every single unmethylated cytosine residue to uracil. If conversion is incomplete, the subsequent analysis will incorrectly interpret the unconverted unmethylated cytosines as methylated cytosines, resulting in false positive results for methylation. Only cytosines in single-stranded DNA are susceptible to attack by bisulfite, therefore denaturation of the DNA undergoing analysis is critical. It is important to ensure that reaction parameters such as temperature and salt concentration are suitable to maintain the DNA in a single-stranded conformation and allow for complete conversion.

According to a particular embodiment, an oxidative bisulfite reaction is performed. 5-methylcytosine and 5-hydroxymethylcytosine both read as a C in bisulfite sequencing. Oxidative bisulfite reaction allows for the discrimination between 5-methylcytosine and 5-hydroxymethylcytosine at single base resolution. The method employs a specific chemical oxidation of 5-hydroxymethylcytosine to 5-formylcytosine, which subsequently converts to uracil during bisulfite treatment. The only base that then reads as a C is 5-methylcytosine, giving a map of the true methylation status in the DNA sample. Levels of 5-hydroxymethylcytosine can also be quantified by measuring the difference between bisulfite and oxidative bisulfite sequencing.

Prior to analysis (or concomitant therewith), the bisulfite-treated DNA sequence which comprises the at least four methylation sites may be subjected to an amplification reaction. If amplification of the sequence is required care should be taken to ensure complete desulfonation of pyrimidine residues. This may be effected by monitoring the pH of the solution to ensure that desulfonation is complete.

As used herein, the term "amplification" refers to a process that increases the representation of a population of specific nucleic acid sequences in a sample by producing multiple (i.e., at least 2) copies of the desired sequences. Methods for nucleic acid amplification are known in the art and include, but are not limited to, polymerase chain reaction (PCR) and ligase chain reaction (LCR). In a typical PCR amplification reaction, a nucleic acid sequence of interest is often amplified at least fifty thousand fold in amount over its amount in the starting sample. A "copy" or "amplicon" does not necessarily mean perfect sequence complementarity or identity to the template sequence. For example, copies can include nucleotide analogs such as deoxyinosine, intentional sequence alterations (such as sequence alterations introduced through a primer comprising a sequence that is hybridizable but not complementary to the template), and/or sequence errors that occur during amplification.

A typical amplification reaction is carried out by contacting a forward and reverse primer (a primer pair) to the sample DNA together with any additional amplification reaction reagents under conditions which allow amplification of the target sequence.

The terms "forward primer" and "forward amplification primer" are used herein interchangeably, and refer to a primer that hybridizes (or anneals) to the target (template strand). The terms "reverse primer" and "reverse amplification primer" are used herein interchangeably, and refer to a primer that hybridizes (or anneals) to the complementary target strand. The forward primer hybridizes with the target sequence 5' with respect to the reverse primer.

The term "amplification conditions", as used herein, refers to conditions that promote annealing and/or extension of primer sequences. Such conditions are well-known in the art and depend on the amplification method selected. Thus, for example, in a PCR reaction, amplification conditions generally comprise thermal cycling, i.e., cycling of the reaction mixture between two or more temperatures. In isothermal amplification reactions, amplification occurs without thermal cycling although an initial temperature increase may be required to initiate the reaction. Amplification conditions encompass all reaction conditions including, but not limited to, temperature and temperature cycling, buffer, salt, ionic strength, and pH, and the like.

As used herein, the term "amplification reaction reagents", refers to reagents used in nucleic acid amplification reactions and may include, but are not limited to, buffers, reagents, enzymes having reverse transcriptase and/or polymerase activity or exonuclease activity, enzyme cofactors such as magnesium or manganese, salts, nicotinamide adenine dinuclease (NAD) and deoxynucleoside triphosphates (dNTPs), such as deoxyadenosine triphospate, deoxyguanosine triphosphate, deoxycytidine triphosphate and thymidine triphosphate. Amplification reaction reagents may readily be selected by one skilled in the art depending on the amplification method used.

According to this aspect of the present invention, the amplifying may be effected using techniques such as polymerase chain reaction (PCR), which includes, but is not limited to Allele-specific PCR, Assembly PCR or Polymerase Cycling Assembly (PCA), Asymmetric PCR, Helicase-dependent amplification, Hot-start PCR, Intersequence-specific PCR (ISSR), Inverse PCR, Ligation-mediated PCR, Methylation-specific PCR (MSP), Miniprimer PCR, Multiplex Ligation-dependent Probe Amplification, Multiplex-PCR, Nested PCR, Overlap-extension PCR, Quantitative PCR (Q-PCR), Reverse Transcription PCR (RT-PCR), Solid Phase PCR: encompasses multiple meanings, including Polony Amplification (where PCR colonies are derived in a gel matrix, for example), Bridge PCR (primers are covalently linked to a solid-support surface), conventional Solid Phase PCR (where Asymmetric PCR is applied in the presence of solid support bearing primer with sequence matching one of the aqueous primers) and Enhanced Solid Phase PCR (where conventional Solid Phase PCR can be improved by employing high Tm and nested solid support primer with optional application of a thermal 'step' to favour solid support priming), Thermal asymmetric interlaced PCR (TAIL-PCR), Touchdown PCR (Step-down PCR), PAN-AC and Universal Fast Walking.

The PCR (or polymerase chain reaction) technique is well-known in the art and has been disclosed, for example, in K. B. Mullis and F. A. Faloona, Methods Enzymol., 1987, 155: 350-355 and U.S. Pat. Nos. 4,683,202; 4,683,195; and 4,800,159 (each of which is incorporated herein by reference in its entirety). In its simplest form, PCR is an in vitro method for the enzymatic synthesis of specific DNA sequences, using two oligonucleotide primers that hybridize to opposite strands and flank the region of interest in the target DNA. A plurality of reaction cycles, each cycle comprising: a denaturation step, an annealing step, and a polymerization step, results in the exponential accumulation of a specific DNA fragment ("PCR Protocols: A Guide to Methods and Applications", M. A. Innis (Ed.), 1990, Academic Press: New York; "PCR Strategies", M. A. Innis (Ed.), 1995, Academic Press: New York; "Polymerase chain reaction: basic principles and automation in PCR: A Practical Approach", McPherson et al. (Eds.), 1991, IRL Press:

Oxford; R. K. Saiki et al., Nature, 1986, 324: 163-166). The termini of the amplified fragments are defined as the 5' ends of the primers. Examples of DNA polymerases capable of producing amplification products in PCR reactions include, but are not limited to: *E. coli* DNA polymerase I, Klenow fragment of DNA polymerase I, T4 DNA polymerase, thermostable DNA polymerases isolated from *Thermus aquaticus* (Taq), available from a variety of sources (for example, Perkin Elmer), *Thermus thermophilus* (United States Biochemicals), *Bacillus* stereothermophilus (Bio-Rad), or *Thermococcus litoralis* ("Vent" polymerase, New England Biolabs). RNA target sequences may be amplified by reverse transcribing the mRNA into cDNA, and then performing PCR (RT-PCR), as described above. Alternatively, a single enzyme may be used for both steps as described in U.S. Pat. No. 5,322,770.

The duration and temperature of each step of a PCR cycle, as well as the number of cycles, are generally adjusted according to the stringency requirements in effect. Annealing temperature and timing are determined both by the efficiency with which a primer is expected to anneal to a template and the degree of mismatch that is to be tolerated. The ability to optimize the reaction cycle conditions is well within the knowledge of one of ordinary skill in the art. Although the number of reaction cycles may vary depending on the detection analysis being performed, it usually is at least 15, more usually at least 20, and may be as high as 60 or higher. However, in many situations, the number of reaction cycles typically ranges from about 20 to about 45.

The denaturation step of a PCR cycle generally comprises heating the reaction mixture to an elevated temperature and maintaining the mixture at the elevated temperature for a period of time sufficient for any double-stranded or hybridized nucleic acid present in the reaction mixture to dissociate. For denaturation, the temperature of the reaction mixture is usually raised to, and maintained at, a temperature ranging from about 85° C. to about 100° C., usually from about 90° C. to about 98° C., and more usually from about 93° C. to about 96° C. for a period of time ranging from about 3 to about 120 seconds, usually from about 5 to about 30 seconds.

Following denaturation, the reaction mixture is subjected to conditions sufficient for primer annealing to template DNA present in the mixture. The temperature to which the reaction mixture is lowered to achieve these conditions is usually chosen to provide optimal efficiency and specificity, and generally ranges from about 50° C. to about ° C., usually from about 55° C. to about 70° C., and more usually from about 60° C. to about 68° C. Annealing conditions are generally maintained for a period of time ranging from about 15 seconds to about 30 minutes, usually from about 30 seconds to about 5 minutes.

Following annealing of primer to template DNA or during annealing of primer to template DNA, the reaction mixture is subjected to conditions sufficient to provide for polymerization of nucleotides to the primer's end in a such manner that the primer is extended in a 5' to 3' direction using the DNA to which it is hybridized as a template, (i.e., conditions sufficient for enzymatic production of primer extension product). To achieve primer extension conditions, the temperature of the reaction mixture is typically raised to a temperature ranging from about 65° C. to about 75° C., usually from about 67° C. to about 73° C., and maintained at that temperature for a period of time ranging from about 15 seconds to about 20 minutes, usually from about 30 seconds to about 5 minutes.

The above cycles of denaturation, annealing, and polymerization may be performed using an automated device typically known as a thermal cycler or thermocycler. Thermal cyclers that may be employed are described in U.S. Pat. Nos. 5,612,473; 5,602,756; 5,538,871; and 5,475,610 (each of which is incorporated herein by reference in its entirety). Thermal cyclers are commercially available, for example, from Perkin Elmer-Applied Biosystems (Norwalk, Conn.), BioRad (Hercules, Calif.), Roche Applied Science (Indianapolis, Ind.), and Stratagene (La Jolla, Calif.).

According to one embodiment, the primers which are used in the amplification reaction are methylation independent primers. These primers flank the first and last of the at least four methylation sites (but do not hybridize directly to the sites) and in a PCR reaction, are capable of generating an amplicon which comprises all four or more methylation sites.

The methylation-independent primers of this aspect of the present invention may comprise adaptor sequences which include barcode sequences. The adaptors may further comprise sequences which are necessary for attaching to a flow cell surface (P5 and P7 sites, for subsequent sequencing), a sequence which encodes for a promoter for an RNA polymerase and/or a restriction site. The barcode sequence may be used to identify a particular molecule, sample or library. The barcode sequence may be between 3-400 nucleotides, more preferably between 3-200 and even more preferably between 3-100 nucleotides. Thus, the barcode sequence may be 6 nucleotides, 7 nucleotides, 8, nucleotides, nine nucleotides or ten nucleotides. The barcode is typically 4-15 nucleotides.

The methylation-independent oligonucleotide of this aspect of the present invention need not reflect the exact sequence of the target nucleic acid sequence (i.e. need not be fully complementary), but must be sufficiently complementary so as to hybridize to the target site under the particular experimental conditions. Accordingly, the sequence of the oligonucleotide typically has at least 70% homology, preferably at least 80%, 90%, 95%, 97%, 99% or 100% homology, for example over a region of at least 13 or more contiguous nucleotides with the target sequence. The conditions are selected such that hybridization of the oligonucleotide to the target site is favored and hybridization to the non-target site is minimized.

Various considerations must be taken into account when selecting the stringency of the hybridization conditions. For example, the more closely the oligonucleotide (e.g. primer) reflects the target nucleic acid sequence, the higher the stringency of the assay conditions can be, although the stringency must not be too high so as to prevent hybridization of the oligonucleotides to the target sequence. Further, the lower the homology of the oligonucleotide to the target sequence, the lower the stringency of the assay conditions should be, although the stringency must not be too low to allow hybridization to non-specific nucleic acid sequences.

As mentioned, the present invention contemplates analyzing more than one target sequence (each one comprising at least four methylation sites on a continuous sequence of the DNA). The sequences may be analyzed individually or as part of a multiplex reaction.

The DNA may be sequenced using any method known in the art—e.g. massively parallel DNA sequencing, sequencing-by-synthesis, sequencing-by-ligation, 454 pyrosequencing, cluster amplification, bridge amplification, and PCR amplification, although preferably, the method comprises a high throughput sequencing method. Typical methods include the sequencing technology and analytical instrumentation offered by Roche 454 Life Sciences™, Branford, Conn., which is sometimes referred to herein as "454 technology" or "454 sequencing."; the sequencing technology and analytical instrumentation offered by Illumina, Inc, San Diego, Calif. (their Solexa Sequencing technology is sometimes referred to herein as the "Solexa method" or "Solexa technology"); or the sequencing technology and analytical instrumentation offered by ABI, Applied Biosystems, Indianapolis, Ind., which is sometimes referred to herein as the ABI-SOLiD™ platform or methodology.

Other known methods for sequencing include, for example, those described in: Sanger, F. et al., Proc. Natl. Acad. Sci. U.S.A. 75, 5463-5467 (1977); Maxam, A. M. & Gilbert, W. Proc Natl Acad Sci USA 74, 560-564 (1977); Ronaghi, M. et al., Science 281, 363, 365 (1998); Lysov, 1. et al., Dokl Akad Nauk SSSR 303, 1508-1511 (1988); Bains W. & Smith G. C. J. Theor Biol 135, 303-307 (1988); Drnanac, R. et al., Genomics 4, 114-128 (1989); Khrapko, K. R. et al., FEBS Lett 256.118-122 (1989); Pevzner P. A. J Biomol Struct Dyn 7, 63-73 (1989); and Southern, E. M. et al., Genomics 13, 1008-1017 (1992). Pyrophosphate-based sequencing reaction as described, e.g., in U.S. Pat. Nos. 6,274,320, 6,258,568 and 6,210,891, may also be used.

The Illumina or Solexa sequencing is based on reversible dye-terminators. DNA molecules are typically attached to primers on a slide and amplified so that local clonal colonies are formed. Subsequently one type of nucleotide at a time may be added, and non-incorporated nucleotides are washed away. Subsequently, images of the fluorescently labeled nucleotides may be taken and the dye is chemically removed from the DNA, allowing a next cycle. The Applied Biosystems' SOLiD technology, employs sequencing by ligation. This method is based on the use of a pool of all possible oligonucleotides of a fixed length, which are labeled according to the sequenced position. Such oligonucleotides are annealed and ligated. Subsequently, the preferential ligation by DNA ligase for matching sequences typically results in a signal informative of the nucleotide at that position. Since the DNA is typically amplified by emulsion PCR, the resulting bead, each containing only copies of the same DNA molecule, can be deposited on a glass slide resulting in sequences of quantities and lengths comparable to Illumina sequencing. Another example of an envisaged sequencing method is pyrosequencing, in particular 454 pyrosequencing, e.g. based on the Roche 454 Genome Sequencer. This method amplifies DNA inside water droplets in an oil solution with each droplet containing a single DNA template attached to a single primer-coated bead that then forms a clonal colony. Pyrosequencing uses luciferase to generate light for detection of the individual nucleotides added to the nascent DNA, and the combined data are used to generate sequence read-outs. A further method is based on Helicos' Heliscope technology, wherein fragments are captured by polyT oligomers tethered to an array. At each sequencing cycle, polymerase and single fluorescently labeled nucleotides are added and the array is imaged. The fluorescent tag is subsequently removed and the cycle is repeated. Further examples of sequencing techniques encompassed within the methods of the present invention are sequencing by hybridization, sequencing by use of nanopores, microscopy-based sequencing techniques, microfluidic Sanger sequencing, or microchip-based sequencing methods. The present invention also envisages further developments of these techniques, e.g. further improvements of the accuracy of the sequence determination, or the time needed for the determination of the genomic sequence of an organism etc.

According to one embodiment, the sequencing method comprises deep sequencing.

As used herein, the term "deep sequencing" and variations thereof refers to the number of times a nucleotide is read during the sequencing process. Deep sequencing indicates that the coverage, or depth, of the process is many times larger than the length of the sequence under study.

It will be appreciated that any of the analytical methods described herein can be embodied in many forms. For example, it can be embodied on a tangible medium such as a computer for performing the method operations. It can be embodied on a computer readable medium, comprising computer readable instructions for carrying out the method operations. It can also be embodied in electronic device having digital computer capabilities arranged to run the computer program on the tangible medium or execute the instruction on a computer readable medium.

Computer programs implementing the analytical method of the present embodiments can commonly be distributed to users on a distribution medium such as, but not limited to, CD-ROMs or flash memory media. From the distribution medium, the computer programs can be copied to a hard disk or a similar intermediate storage medium. In some embodiments of the present invention, computer programs implementing the method of the present embodiments can be distributed to users by allowing the user to download the programs from a remote location, via a communication network, e.g., the internet. The computer programs can be run by loading the computer instructions either from their distribution medium or their intermediate storage medium into the execution memory of the computer, configuring the computer to act in accordance with the method of this invention. All these operations are well-known to those skilled in the art of computer systems.

Additional methods which rely on the use of bisulfite that may be used to analyze the methylation pattern as described herein are described herein below:

Methylation-Sensitive Single-Nucleotide Primer Extension:

DNA is bisulfite-converted, and bisulfite-specific primers are annealed to the sequence up to the base pair immediately before the CpG of interest. The primer is allowed to extend one base pair into the C (or T) using DNA polymerase terminating dideoxynucleotides, and the ratio of C to T is determined quantitatively. A number of methods can be used to determine this C:T ratio, such as the use of radioactive ddNTPs as the reporter of the primer extension, fluorescence-based methods or Pyrosequencing can also be used. Matrix-assisted laser desorption ionization/time-of-flight (MALDI-TOF) mass spectrometry analysis can be used to differentiate between the two polymorphic primer extension products can be used, in essence, based on the GOOD assay designed for SNP genotyping. Ion pair reverse-phase high-performance liquid chromatography (IP-RP-HPLC) can also be used to distinguish primer extension products.

Base-Specific Cleavage/MALDI-TOF:

This method takes advantage of bisulfite-conversions by adding a base-specific cleavage step to enhance the information gained from the nucleotide changes. By first using in vitro transcription of the region of interest into RNA (by adding an RNA polymerase promoter site to the PCR primer in the initial amplification), RNase A can be used to cleave the RNA transcript at base-specific sites. As RNase A cleaves RNA specifically at cytosine and uracil ribonucleotides, base-specificity is achieved by adding incorporating cleavage-resistant dTTP when cytosine-specific (C-specific) cleavage is desired, and incorporating dCTP when uracil-specific (U-specific) cleavage is desired. The cleaved fragments can then be analyzed by MALDI-TOF. Bisulfite treatment results in either introduction/removal of cleavage sites by C-to-U conversions or shift in fragment mass by G-to-A conversions in the amplified reverse strand. C-specific cleavage will cut specifically at all methylated CpG sites. By analyzing the sizes of the resulting fragments, it is possible to determine the specific pattern of DNA methylation of CpG sites within the region.

The present inventors further contemplate analyzing the methylation status of the at least four sites including the use of methylation-dependent oligonucleotides.

Methylation dependent oligonucleotides hybridize to either the methylated form of the at least one methylation site or the unmethylated form of the at least one methylation site.

According to one embodiment, the methylation dependent olignoucleotide is a probe. In one embodiment, the probe hybridizes to the methylated site to provide a detectable signal under experimental conditions and does not hybridize to the non-methylated site to provide a detectable signal under identical experimental conditions. In another embodiment, the probe hybridizes to the non-methylated site to provide a detectable signal under experimental conditions and does not hybridize to the methylated site to provide a detectable signal under identical experimental conditions. The probes of this embodiment of this aspect of the present invention may be, for example, affixed to a solid support (e.g., arrays or beads).

According to another embodiment, the methylation dependent olignoucleotide is a primer which when used in an amplification reaction is capable of amplifying the target sequence, when the methylation site is methylated. According to another embodiment, the methylation dependent olignoucleotide is a primer which when used in an amplification reaction is capable of amplifying the target sequence, when the methylation site is unmethylated—see for example International PCT Publication No. WO2013131083, the contents of which are incorporated herein by reference.

The methylation-dependent oligonucleotide of this aspect of the present invention need not reflect the exact sequence of the target nucleic acid sequence (i.e. need not be fully complementary), but must be sufficiently complementary so as to distinguish between a methylated and non-methylated site under the particular experimental conditions. Accordingly, the sequence of the oligonucleotide typically has at least 70% homology, preferably at least 80%, 90%, 95%, 97%, 99% or 100% homology, for example over a region of at least 13 or more contiguous nucleotides with the target sequence. The conditions are selected such that hybridization of the oligonucleotide to the methylated site is favored and hybridization to the non-methylated site is minimized (and vice versa).

By way of example, hybridization of short nucleic acids (below 200 bp in length, e.g. 13-50 bp in length) can be effected by the following hybridization protocols depending on the desired stringency; (i) hybridization solution of 6×SSC and 1% SDS or 3 M TMAC1, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 1-1.5° C. below the Tm, final wash solution of 3 M TMAC1, 0.01 M sodium phosphate (pH 6.8), 1 mM EDTA (pH 7.6), 0.5% SDS at 1-1.5° C. below the Tm (stringent hybridization conditions) (ii) hybridization solution of 6×SSC and 0.1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature of 2-2.5° C. below the Tm, final wash solution of 3 M TMAC1, 0.01 M sodium phosphate (pH 6.8), 1 mM EDTA (pH 7.6), 0.5% SDS at 1-1.5° C. below the Tm, final wash solution of 6×SSC, and final wash at 22° C. (stringent to moderate hybridization conditions); and (iii) hybridization solution of 6×SSC and 1% SDS or 3 M TMACl, 0.01 M sodium phosphate (pH 6.8), 1 mM EDTA (pH 7.6), 0.5% SDS, 100 µg/ml denatured salmon sperm DNA and 0.1% nonfat dried milk, hybridization temperature at 2.5-3° C. below the Tm and final wash solution of 6×SSC at 22° C. (moderate hybridization solution).

Oligonucleotides of the invention may be prepared by any of a variety of methods (see, for example, J. Sambrook et al., "Molecular Cloning: A Laboratory Manual", 1989, 2.sup.nd Ed., Cold Spring Harbour Laboratory Press: New York, N.Y.; "PCR Protocols: A Guide to Methods and Applications", 1990, M. A. Innis (Ed.), Academic Press: New York, N.Y.; P. Tijssen "Hybridization with Nucleic Acid Probes—Laboratory Techniques in Biochemistry and Molecular Biology (Parts I and II)", 1993, Elsevier Science; "PCR Strategies", 1995, M. A. Innis (Ed.), Academic Press: New York, N.Y.; and "Short Protocols in Molecular Biology", 2002, F. M. Ausubel (Ed.), 5.sup.th Ed., John Wiley & Sons: Secaucus, N.J.). For example, oligonucleotides may be prepared using any of a variety of chemical techniques well-known in the art, including, for example, chemical synthesis and polymerization based on a template as described, for example, in S. A. Narang et al., Meth. Enzymol. 1979, 68: 90-98; E. L. Brown et al., Meth. Enzymol. 1979, 68: 109-151; E. S. Belousov et al., Nucleic Acids Res. 1997, 25: 3440-3444; D. Guschin et al., Anal. Biochem. 1997, 250: 203-211; M. J. Blommers et al., Biochemistry, 1994, 33: 7886-7896; and K. Frenkel et al., Free Radic. Biol. Med. 1995, 19: 373-380; and U.S. Pat. No. 4,458,066.

For example, oligonucleotides may be prepared using an automated, solid-phase procedure based on the phosphoramidite approach. In such a method, each nucleotide is individually added to the 5'-end of the growing oligonucleotide chain, which is attached at the 3'-end to a solid support. The added nucleotides are in the form of trivalent 3'-phosphoramidites that are protected from polymerization by a dimethoxytriyl (or DMT) group at the 5'-position. After base-induced phosphoramidite coupling, mild oxidation to give a pentavalent phosphotriester intermediate and DMT removal provides a new site for oligonucleotide elongation. The oligonucleotides are then cleaved off the solid support, and the phosphodiester and exocyclic amino groups are deprotected with ammonium hydroxide. These syntheses may be performed on oligo synthesizers such as those commercially available from Perkin Elmer/Applied Biosystems, Inc. (Foster City, Calif.), DuPont (Wilmington, Del.) or Milligen (Bedford, Mass.). Alternatively, oligonucleotides can be custom made and ordered from a variety of commercial sources well-known in the art, including, for example, the Midland Certified Reagent Company (Midland, Tex.), ExpressGen, Inc. (Chicago, Ill.), Operon Technologies, Inc. (Huntsville, Ala.), and many others.

Purification of the oligonucleotides of the invention, where necessary or desirable, may be carried out by any of a variety of methods well-known in the art. Purification of oligonucleotides is typically performed either by native acrylamide gel electrophoresis, by anion-exchange HPLC as described, for example, by J. D. Pearson and F. E. Regnier (J. Chrom., 1983, 255: 137-149) or by reverse phase HPLC (G. D. McFarland and P. N. Borer, Nucleic Acids Res., 1979, 7: 1067-1080).

The sequence of oligonucleotides can be verified using any suitable sequencing method including, but not limited to, chemical degradation (A. M. Maxam and W. Gilbert, Methods of Enzymology, 1980, 65: 499-560), matrix-assisted laser desorption ionization time-of-flight (MALDI-TOF) mass spectrometry (U. Pieles et al., Nucleic Acids Res., 1993, 21: 3191-3196), mass spectrometry following a combination of alkaline phosphatase and exonuclease digestions (H. Wu and H. Aboleneen, Anal. Biochem., 2001, 290: 347-352), and the like.

In certain embodiments, the detection probes or amplification primers or both probes and primers are labeled with a detectable agent or moiety before being used in amplification/detection assays. In certain embodiments, the detection probes are labeled with a detectable agent. Preferably, a detectable agent is selected such that it generates a signal which can be measured and whose intensity is related (e.g., proportional) to the amount of amplification products in the sample being analyzed.

The association between the oligonucleotide and detectable agent can be covalent or non-covalent. Labeled detection probes can be prepared by incorporation of or conjugation to a detectable moiety. Labels can be attached directly to the nucleic acid sequence or indirectly (e.g., through a linker). Linkers or spacer arms of various lengths are known in the art and are commercially available, and can be selected to reduce steric hindrance, or to confer other useful or desired properties to the resulting labeled molecules (see, for example, E. S. Mansfield et al., Mol. Cell. Probes, 1995, 9: 145-156).

Methods for labeling nucleic acid molecules are well-known in the art. For a review of labeling protocols, label detection techniques, and recent developments in the field, see, for example, L. J. Kricka, Ann. Clin. Biochem. 2002, 39: 114-129; R. P. van Gijlswijk et al., Expert Rev. Mol. Diagn. 2001, 1: 81-91; and S. Joos et al., J. Biotechnol. 1994, 35: 135-153. Standard nucleic acid labeling methods include: incorporation of radioactive agents, direct attachments of fluorescent dyes (L. M. Smith et al., Nucl. Acids Res., 1985, 13: 2399-2412) or of enzymes (B. A. Connolly and O. Rider, Nucl. Acids. Res., 1985, 13: 4485-4502); chemical modifications of nucleic acid molecules making them detectable immunochemically or by other affinity reactions (T. R. Broker et al., Nucl. Acids Res. 1978, 5: 363-384; E. A. Bayer et al., Methods of Biochem. Analysis, 1980, 26: 1-45; R. Langer et al., Proc. Natl. Acad. Sci. USA, 1981, 78: 6633-6637; R. W. Richardson et al., Nucl. Acids Res. 1983, 11: 6167-6184; D. J. Brigati et al., Virol. 1983, 126: 32-50; P. Tchen et al., Proc. Natl. Acad. Sci. USA, 1984, 81: 3466-3470; J. E. Landegent et al., Exp. Cell Res. 1984, 15: 61-72; and A. H. Hopman et al., Exp. Cell Res. 1987, 169: 357-368); and enzyme-mediated labeling methods, such as random priming, nick translation, PCR and tailing with terminal transferase (for a review on enzymatic labeling, see, for example, J. Temsamani and S. Agrawal, Mol. Biotechnol. 1996, 5: 223-232). More recently developed nucleic acid labeling systems include, but are not limited to: ULS (Universal Linkage System), which is based on the reaction of mono-reactive cisplatin derivatives with the N7 position of guanine moieties in DNA (R. J. Heeterij et al., Cytogenet. Cell. Genet. 1999, 87: 47-52), psoralen-biotin, which intercalates into nucleic acids and upon UV irradiation becomes covalently bonded to the nucleotide bases (C. Levenson et al., Methods Enzymol. 1990, 184: 577-583; and C. Pfannschmidt et al., Nucleic Acids Res. 1996, 24: 1702-1709), photoreactive azido derivatives (C. Neves et al., Bioconjugate Chem. 2000, 11: 51-55), and DNA alkylating agents (M. G. Sebestyen et al., Nat. Biotechnol. 1998, 16: 568-576).

Any of a wide variety of detectable agents can be used in the practice of the present invention. Suitable detectable agents include, but are not limited to, various ligands, radionuclides (such as, for example, $^{32}$P, $^{35}$S, $^{3}$H, $^{14}$C, $^{125}$I, $^{131}$I, and the like); fluorescent dyes (for specific exemplary fluorescent dyes, see below); chemiluminescent agents (such as, for example, acridinium esters, stabilized dioxetanes, and the like); spectrally resolvable inorganic fluorescent semiconductor nanocrystals (i.e., quantum dots), metal nanoparticles (e.g., gold, silver, copper and platinum) or nanoclusters; enzymes (such as, for example, those used in an ELISA, i.e., horseradish peroxidase, beta-galactosidase, luciferase, alkaline phosphatase); colorimetric labels (such as, for example, dyes, colloidal gold, and the like); magnetic labels (such as, for example, Dynabeads™); and biotin, dioxigenin or other haptens and proteins for which antisera or monoclonal antibodies are available.

In certain embodiments, the inventive detection probes are fluorescently labeled. Numerous known fluorescent labeling moieties of a wide variety of chemical structures and physical characteristics are suitable for use in the practice of this invention. Suitable fluorescent dyes include, but are not limited to, fluorescein and fluorescein dyes (e.g., fluorescein isothiocyanine or FITC, naphthofluorescein, 4',5'-dichloro-2',7'-dimethoxy-fluorescein, 6 carboxyfluorescein or FAM), carbocyanine, merocyanine, styryl dyes, oxonol dyes, phycoerythrin, erythrosin, eosin, rhodamine dyes (e.g., carboxytetramethylrhodamine or TAMRA, carboxyrhodamine 6G, carboxy-X-rhodamine (ROX), lissamine rhodamine B, rhodamine 6G, rhodamine Green, rhodamine Red, tetramethylrhodamine or TMR), coumarin and coumarin dyes (e.g., methoxycoumarin, dialkylaminocoumarin, hydroxycoumarin and aminomethylcoumarin or AMCA), Oregon Green Dyes (e.g., Oregon Green 488, Oregon Green 500, Oregon Green 514), Texas Red, Texas Red-X, Spectrum Red™, Spectrum Green™, cyanine dyes (e.g., Cy-3™, Cy-5™, Cy-3.5™, Cy-5.5™), Alexa Fluor dyes (e.g., Alexa Fluor 350, Alexa Fluor 488, Alexa Fluor 532, Alexa Fluor 546, Alexa Fluor 568, Alexa Fluor 594, Alexa Fluor 633, Alexa Fluor 660 and Alexa Fluor 680), BODIPY dyes (e.g., BODIPY FL, BODIPY R6G, BODIPY TMR, BODIPY TR, BODIPY 530/550, BODIPY 558/568, BODIPY 564/570, BODIPY 576/589, BODIPY 581/591, BODIPY 630/650, BODIPY 650/665), IRDyes (e.g., IRD40, IRD 700, IRD 800), and the like. For more examples of suitable fluorescent dyes and methods for linking or incorporating fluorescent dyes to nucleic acid molecules see, for example, "The Handbook of Fluorescent Probes and Research Products", 9th Ed., Molecular Probes, Inc., Eugene, Oreg. Fluorescent dyes as well as labeling kits are commercially available from, for example, Amersham Biosciences, Inc. (Piscataway, N.J.), Molecular Probes Inc. (Eugene, Oreg.), and New England Biolabs Inc. (Beverly, Mass.). Another contemplated method of analyzing the methylation status of the sequences is by analysis of the DNA following exposure to methylation-sensitive restriction enzymes—see for example US Application Nos. 20130084571 and 20120003634, the contents of which are incorporated herein.

It will be appreciated that analysis of the methylation status according to methods described herein allows for the accurate determination of cellular source of a DNA molecule, even when the majority of the DNA of the sample is derived from a different cellular source. The present inventors have shown that they are able to determine the cellular source of a particular DNA even when its contribution to the total amount of DNA in the population is less than 1:1000, less than 1:5,000, 1:10,000 or even 1:100,000.

Pathological and disease conditions that involve cell death cause the release of degraded DNA from dying cells into body fluids (blood, plasma, urine, cerebrospinal fluid). Thus, the methods described herein may be used to analyze the amount of cell death of a particular cell population in those body fluids. The amount of cell death of a particular cell population can then be used to diagnose a particular pathological state (e.g. disease) or condition (e.g. trauma).

Thus, according to another aspect of the present invention there is provided a method of detecting death of a cell type or tissue in a subject comprising determining whether cell-free DNA comprised in a fluid sample of the subject is derived from the cell type or tissue, wherein the determining is effected by ascertaining the methylation status of at least four methylation sites on a continuous sequence of the cell-free DNA, the sequence comprising no more than 300 nucleotides, wherein a methylation status of each of the at least four methylation sites on the continuous sequence of the DNA characteristic of the cell type or tissue is indicative of death of the cell type or tissue.

It will be appreciated that death of a particular cell type may be associated with a pathological state—e.g. disease or trauma.

The monitoring of the death of a particular cell type may also be used for monitoring the efficiency of a therapeutic regime expected to effect cell death of a specific cell type.

The determination of death of a specific cell type may also be used in the clinical or scientific study of various mechanism of healthy or diseased subjects.

Thus, for example measurement of pancreatic beta cell death is important in cases of diabetes, hyperinsulinism and islet cell tumors, and in order to monitor beta cell survival after islet transplantation, determining the efficacy of various treatment regimes used to protect beta cells from death, and determining the efficacy of treatments aimed at causing islet cell death in islet cell tumors. Similarly, the method allows the identification and quantification of DNA derived from dead kidney cells (diagnostic of kidney failure), dead neurons (diagnostic of traumatic brain injury, amyotrophic lateral sclerosis (ALS), stroke, Alzheimer's disease, Parkinson's disease or brain tumors, with or without treatment); dead pancreatic acinar cells (diagnostic of pancreatic cancer or pancreatitis); dead lung cells (diagnostic of lung pathologies including lung cancer); dead adipocytes (diagnostic of altered fat turnover), dead hepatocytes (indicative of liver failure, liver toxicity or liver cancer) dead cardiomyocytes (indicative of cardiac disease, or graft failure in the case of cardiac transplantation), dead skeletal muscle cells (diagnostic of muscle injury and myopathies), dead oligodendrocytes (indicative of relapsing multiple sclerosis, white matter damage in amyotrophic lateral sclerosis, or glioblastoma).

According to one embodiment, the sequences analyzed have methylation patterns which characterize the normal cell of interest and is not methylation patterns characterizing a diseased cell (is not for example a methylation pattern characterizing cancer cells of a specific type). Exemplary sequences which may be analyzed are comprised in sequences set forth in SEQ ID NOs: 1-1484. These sequences are further described herein above.

As used herein, the term "diagnosing" refers to determining the presence of a disease, classifying a disease, determining a severity of the disease (grade or stage), monitoring disease progression and response to therapy, forecasting an outcome of the disease and/or prospects of recovery.

The method comprises quantifying the amount of cell-free DNA which is comprised in a fluid sample (e.g. a blood sample) of the subject which is derived from a cell type or tissue. When the amount of cell free DNA derived from the cell type or tissue is above a predetermined level, it is indicative that there is a predetermined level of cell death. When the level of cell death is above a predetermined level, it is indicative that the subject has the disease or pathological state. Determining the predetermined level may be carried out by analyzing the amount of cell-free DNA present in a sample derived from a subject known not to have the disease/pathological state. If the level of the cell-free DNA derived from a cell type or tissue associated with the disease in the test sample is statistically significantly higher than the level of cell-free DNA derived from the same cell type or tissue in the sample obtained from the healthy (non-diseased subject), it is indicative that the subject has the disease. Alternatively, or additionally, determining the predetermined level may be carried out by analyzing the amount of cell-free DNA present in a sample derived from a subject known to have the disease. If the level of the cell-free DNA derived from a cell type or tissue associated with the disease in the test sample is statistically significantly similar to the level of the cell-free DNA derived from a cell type of tissue associated with the disease in the sample obtained from the diseased subject, it is indicative that the subject has the disease.

The severity of disease may be determined by quantifying the amount of DNA molecules having the specific methylation pattern of a cell population associated with the disease. Quantifying the amount of DNA molecules having the specific methylation pattern of a target tissue may be achieved using a calibration curve produced by using known and varying numbers of cells from the target tissue.

According to one embodiment, the method comprises determining the ratio of the amount of cell free DNA derived from a cell of interest in the sample: amount of overall cell free DNA.

According to still another embodiment, the method comprises determining the ratio of the amount of cell free DNA derived from a cell of interest in the sample: amount of cell free DNA derived from a second cell of interest.

The methods described herein may also be used to determine the efficacy of a therapeutic agent or treatment, wherein when the amount of DNA associated with a cell population associated with the disease is decreased following administration of the therapeutic agent, it is indicative that the agent or treatment is therapeutic.

Kits

Any of the components described herein may be comprised in a kit. In a non-limiting example the kit comprises at least one primer pair capable of amplifying a DNA sequence whose methylation status is indicative of a disease, as described herein above. According to one embodiment, the primers further comprise barcode sequences and/or sequences which allow for downstream sequencing, as further described herein above. Such primer sequences include for example those set forth in SEQ ID NOs: 1485-1496. According to one embodiment, each primer of the primer pair is comprised in a suitable container. According to another embodiment, the kit comprises two primer pairs capable of amplifying two different DNA sequences whose methylation status is indicative of a disease, as described herein above. According to another embodiment, the kit comprises three primer pairs capable of amplifying three different DNA sequences whose methylation status is indicative of a disease, as described herein above. According to another embodiment, the kit comprises four primer pairs capable of amplifying four different DNA sequences whose methylation status is indicative of a disease, as described herein above. According to another embodiment, the kit comprises five or more primer pairs capable of amplifying the five or more different DNA sequences whose methylation status is indicative of a disease, as described herein above.

In another non-limiting example the kit comprises oligonucleotides which are capable of detecting the methylation status of at least four methylation sites in a nucleic acid sequence, the nucleic acid sequence being no longer than 300 base pairs and comprising at least four methylation sites which are differentially methylated in a first cell of interest with respect to a second cell which is non-identical to the first cell of interest. The kit may comprise one oligonucleotide which is capable of detecting the methylation status of the at least four methylation sites in a nucleic acid sequence. The kit may comprise two oligonucleotides which, in combination are capable of detecting the methylation status of the at least four methylation sites in a nucleic acid sequence. The kit may comprise three oligonucleotides which, in combination are capable of detecting the methylation status of the at least four methylation sites in a nucleic acid sequence. The kit may comprise four oligonucleotides which, in combination are capable of detecting the methylation status of the at least four methylation sites in a nucleic acid sequence. The oligonucleotides of this aspect of the present invention may be labeled with a detectable moiety as further described herein above.

Additional components that may be included in any of the above described kits include at least one of the following components: bisulfite (and other reagents necessary for the bisulfite reaction), a polymerase enzyme, reagents for purification of DNA, $MgCl_2$. The kit may also comprise reaction components for sequencing the amplified or non-amplified sequences.

The kits may also comprise DNA sequences which serve as controls. Thus, for example, the kit may comprise a DNA having the same sequence as the amplified sequence derived from a healthy subject (to serve as a negative control) and/or a DNA having the same sequence as the amplified sequence derived from a subject known to have the disease which is being investigated (to serve as a positive control).

In addition, the kits may comprise known quantities of DNA such that calibration and quantification of the test DNA may be carried out.

The containers of the kits will generally include at least one vial, test tube, flask, bottle, syringe or other containers, into which a component may be placed, and preferably, suitably aliquoted. Where there is more than one component in the kit, the kit also will generally contain a second, third or other additional container into which the additional components may be separately placed. However, various combinations of components may be comprised in a container.

When the components of the kit are provided in one or more liquid solutions, the liquid solution can be an aqueous solution. However, the components of the kit may be provided as dried powder(s). When reagents and/or components are provided as a dry powder, the powder can be reconstituted by the addition of a suitable solvent.

A kit will preferably include instructions for employing, the kit components as well the use of any other reagent not included in the kit. Instructions may include variations that can be implemented.

It is expected that during the life of a patent maturing from this application many relevant sequencing technologies will be developed (including those that will be able to determine methylation status, without bisulfite treatment) and the scope of the term sequencing is intended to include all such new technologies a priori.

As used herein the term "about" refers to ±10%.

The terms "comprises", "comprising", "includes", "including", "having" and their conjugates mean "including but not limited to".

The term "consisting of" means "including and limited to".

The term "consisting essentially of" means that the composition, method or structure may include additional ingredients, steps and/or parts, but only if the additional ingredients, steps and/or parts do not materially alter the basic and novel characteristics of the claimed composition, method or structure.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Generally, the nomenclature used herein and the laboratory procedures utilized in the present invention include molecular, biochemical, microbiological and recombinant DNA techniques. Such techniques are thoroughly explained in the literature. See, for example, "Molecular Cloning: A laboratory Manual" Sambrook et al., (1989); "Current Protocols in Molecular Biology" Volumes I-III Ausubel, R. M., ed. (1994); Ausubel et al., "Current Protocols in Molecular Biology", John Wiley and Sons, Baltimore, Md. (1989); Perbal, "A Practical Guide to Molecular Cloning", John Wiley & Sons, New York (1988); Watson et al., "Recombinant DNA", Scientific American Books, New York; Birren et al. (eds) "Genome Analysis: A Laboratory Manual Series", Vols. 1-4, Cold Spring Harbor Laboratory Press, New York (1998); methodologies as set forth in U.S. Pat. Nos. 4,666,828; 4,683,202; 4,801,531; 5,192,659 and 5,272,057; "Cell Biology: A Laboratory Handbook", Volumes I-III Cellis, J. E., ed. (1994); "Culture of Animal Cells—A Manual of Basic Technique" by Freshney, Wiley-Liss, N. Y. (1994), Third Edition; "Current Protocols in Immunology" Volumes I-III Coligan J. E., ed. (1994); Stites et al. (eds), "Basic and Clinical Immunology" (8th Edition), Appleton & Lange, Norwalk, Conn. (1994); Mishell and Shiigi (eds), "Selected Methods in Cellular Immunology", W. H. Freeman and Co., New York (1980); available immunoassays are extensively described in the patent and scientific literature, see, for example, U.S. Pat. Nos. 3,791,932; 3,839,153; 3,850,752; 3,850,578; 3,853,987; 3,867,517; 3,879,262; 3,901,654; 3,935,074; 3,984,533; 3,996,345; 4,034,074; 4,098,876; 4,879,219; 5,011,771 and 5,281,521; "Oligonucleotide Synthesis" Gait, M. J., ed. (1984); "Nucleic Acid Hybridization" Hames, B. D., and Higgins S. J., eds. (1985); "Transcription and Translation" Hames, B. D., and Higgins S. J., eds. (1984); "Animal Cell Culture" Freshney, R. I., ed. (1986); "Immobilized Cells and Enzymes" IRL Press, (1986); "A Practical Guide to Molecular Cloning" Perbal, B., (1984) and "Methods in Enzymology" Vol. 1-317, Academic Press; "PCR Protocols: A Guide To Methods And Applications", Academic Press, San Diego, Calif. (1990); Marshak et al., "Strategies for Protein Purification and Characterization—A Laboratory Course Manual" CSHL Press (1996); all of which are incorporated by reference as if fully set forth herein. Other general references are provided throughout this document. The procedures therein are believed to be well known in the art and are provided for the convenience of the reader. All the information contained therein is incorporated herein by reference.

Materials and Methods

Patients:

All clinical studies were approved by the relevant local ethics committees and informed consent was obtained from all subjects or their legal guardians prior to blood sampling.

1. Recently diagnosed T1D patients: plasma was prepared from 11 patients (ages 4-20, mean 9.5 years) that were diagnosed with T1D 1-4 months earlier.

2. Islet graft recipients: Patients were 44-57 years old, with T1D duration of 10-36 years and poorly controlled blood glucose levels (HbA1C 6.4-10). Anti rejection therapy included Alemtuzumab, Etanercept and Anakinra. Maintenance therapy included tacrolimus and MMF.

3. MS/NMO patients: MS and NMO patients were diagnosed according to the 2010 McDonald criteria (1) and the NMO diagnostic criteria respectively (2). Patients characteristics were as follows: Relapsing—remitting MS patients, n=49, 74% females, average age=36±12.5, range 18-68 years, disease duration 4±4.5 years, range 0-14 years. Expanded Disability Status Scale (EDSS)=2.8±1.8, range 1-7.5. None of the patients had received steroid treatment for 2 months prior to testing. In patients in relapse, blood was drawn prior to IV steroid therapy. At the time of sampling one patient was treated with Copaxone and 4 with Imuran.

4. Cardiac arrest patients: samples were collected at the intensive care unit (ICU) at Uppsala University Hospital, Sweden. Unconscious patients with cardiac arrest were resuscitated with restoration of spontaneous circulation (ROSC). Hypothermia treatment to a body temperature of 32-34° C. for 24 h, ventilation, and pharmacologic support were administered immediately after resuscitation as described (Mörtberg E et al., Resuscitation 2011; 82:26-31). Patients were defined as comatose if they were (i) not awake, (ii) not following any commands, and (iii) not responding to any stimuli. All patients received an arterial line in the radial or femoral artery for blood sampling. Serial blood samples were collected, starting as soon as possible in the emergency phase and continuing at 24, 48, 72, 96 and 108 hours after cardiac arrest. Serum aliquots were frozen at −70° C. until analysis.

5. Traumatic brain injury: 5 patients (3 males and 2 females, all Caucasian, average age 39) with isolated severe traumatic brain injury (TBI) were enrolled from a clinical study at the Neurointensive Care Unit (NICU) at the Sahlgrenska University Hospital, Gothenburg, Sweden. All patients had a mixture of focal contusions and general oedema. All had severe TBI according to the following criteria: 1) Reaction Level Scale (RLS) 4, corresponding to a score of 8 on the Glasgow Coma Scale (3=no response, 15=awake) (3); 2) were in need on ventilator treatment; 3) monitoring of intracranial pressure (ICP). Venous blood samples were taken on serial days after trauma. After clinical and radiologic evaluations, the patients underwent neurosurgical intervention within hours after admission, to receive an indwelling ventricular catheter for intracranial pressure (ICP) monitoring/therapeutic CSF drainage. When appropriate, space-occupying lesions like hemorrhages and contusions were surgically removed. Patients were then treated in accordance with a standardized protocol: "the Lund concept", with the aim to maintain cerebral perfusion pressure above 60 mm Hg and the intracranial pressure of below 20 mm Hg (4). Data collected included demographic and clinical variables such as age, sex and time of injury. Physiologic and laboratory variables were continuously recorded throughout the study period and concomitantly adjusted to be kept within the following limits: Hemoglobin >120 g/L, serum sodium >135 to <150 mmol/L, serum potassium >4.0 to <5.0 mmol/L, serum albumin >35 to <50 g/L, core temperature 37+−0.5° C., mean arterial blood pressure (MABP) between 70 and 100 mm Hg, ICP <20 mm Hg, cerebral perfusion pressure CPP (MABP—ICP) >60 mm Hg, $PO_2$ >12 to <18 kPa, PCO2 around 4.5 kPa and normalized pH. Blood glucose was kept between 4 and 6 mmol/L according to NICU routine. No patient has received steroids.

6. Pancreatic cancer and chronic pancreatitis: Plasma was prepared from 42 patients with pathologically confirmed pancreatic adenocarcinoma (28 males and 14 females; average age 68, range 41-87) and 10 patients with chronic pancreatitis. The American joint committee on cancer TNM staging of pancreatic cancer (2010) was used. At the time of plasma collection 29 patients had a localized disease (4 at stage I and 25 at Stage II, all pre-operative) and 13 patients had a metastatic disease, Stage IV.

7. Healthy Controls: A total of 40 healthy individuals (50% females; ages 22 60) volunteered to participate in the study as unpaid healthy controls. All denied having any signs of symptoms related to the disease state studied.

DNA processing: Cell free DNA was isolated from plasma or serum using a kit (Qiaquick, Qiagen), and treated with bisulfite (Zymo research). Bisulfite treated DNA was PCR amplified, using primers specific for bisulfite-treated DNA but independent of methylation status at monitored CpG sites. Primers were bar-coded, allowing to mix samples from different individuals when sequencing products using MiSeq (Illumina).

Methylome of pancreatic acinar and ductal cells: Duct and acinar cells were isolated from dissociated cadaveric human pancreata as previously described. Live cells were stained with cell surface markers and sorted. Genomic DNA was isolated using phenol/chloroform and processed for Illumina 450 k arrays per manufacturer instructions.

Insulin
Primer sequences: SEQ ID NOs: 1485 and 1486
MBP3
Primer sequences: SEQ ID NOs: 1495 and 1496
CG10809560 (WM1)
Primer sequences: SEQ ID NOs: 1491 and 1492
CG09787504
Primer sequences: SEQ ID NOs: 1493 and 1494
Pancreas (CUX2)
Primer sequences: SEQ ID NOs: 1487 and 1488
Pancreas (REG1A)
Primer sequences: SEQ ID NOs: 1489 and 1490

Statistical analysis: To assess the significance of differences between groups a 2-tailed MannWhitney test was used, based on values of unmethylated tissue-specific DNA in each patient.

Example 1

Identification of Tissue-Specific Methylation Markers

The present inventors identified tissue-specific DNA methylation markers, distinguishing individual tissues or cell types from other tissues. Particular attention was given to markers that differ between a tissue of interest and hematopoietic cells, which are thought to be the main contributor of cfDNA and therefore the major potential source of noise in the system. They analyzed publicly available methylomes (mostly Illumina 450 k array data from The Cancer Genome Atlas [TOGA] and Gene Expression Omnibus [GEO]) to identify individual CpG dinucleotides with differential methylation patterns, unmethylated specifically in one tissue and methylated elsewhere (see schematic of procedure, FIGS. 5A-B).

The Illumina arrays provide information on the methylation status of individual CpG dinucleotides. The discriminatory power of each site is limited, since it can be randomly methylated or unmethylated in a small fraction of molecules from tissues where it is typically unmethylated or methylated, respectively. To increase the signal to noise ratio of the assay, the present inventors took advantage of the regional nature of DNA methylation. They defined an "expanded window" of 4-9 CpG sites adjacent to the original CpG marker site, reasoning that the chances are small for accidental methylation or demethylation of multiple adjacent cytosines in the same molecule. To determine the status of methylation of these expanded windows, they obtained DNA from different human tissues, and treated it with bisulfite to convert unmethylated cytosines to uracils. Short fragments containing the signature CpG site and multiple adjacent CpGs were then PCR-amplified, and sequenced multiple molecules from the PCR product using Illumina MiSeq.

As an alternative approach to the comparisons between Illumina methylome arrays, in some cases the present inventors selected and validated tissue specific markers based on promoters of known tissue specific genes, (which might not be adequately represented in the Illumina arrays) (FIGS. 5A-B). As shown in the examples below, scoring for DNA molecules in which multiple adjacent CpG sites share the same tissue-specific methylation pattern gave a dramatically higher discriminatory power between the tissue of interest and other tissues, compared with the information content of individual CpG sites. Thus, the present inventors have defined short sequences of DNA, containing 4-9 CpG sites, whose combined methylation status constitutes an epigenetic signature unique to a tissue of interest relative to blood cells and other tissues.

Example 2

Figure 1A:
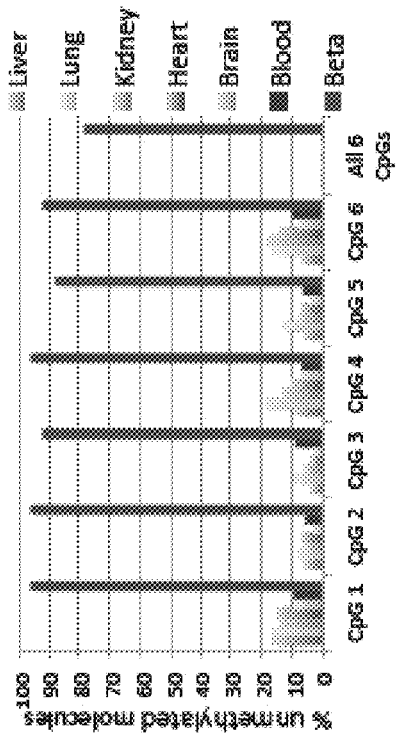
Figure 1B:
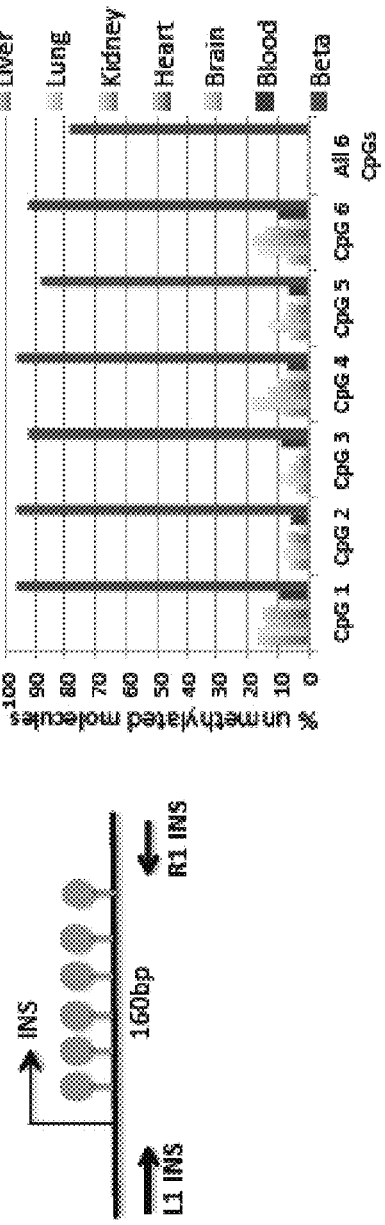

Presence of Unmethylated Insulin Gene Promoter in the Circulation of T1D Patients To detect cfDNA derived from beta-cells, the insulin gene promoter was used as a beta-cell specific methylation marker. Previous studies seeking to identify DNA derived from beta-cells in peripheral blood samples have utilized methylation-specific PCR based on the methylation status of 2-3 CpG dinucleotides in the insulin promoter (J et al., Diabetes 62, 1676-1680 (2013)). However, the insulin promoter contains additional CpG sites in close proximity, which can be used to improve the distinction between DNA of beta-cells and other tissues (FIG. 1A). To test this concept, a 160 bp fragment of the insulin gene promoter was amplified from bisulfite-treated DNA obtained from multiple tissues, and the product was sequenced to determine the methylation status of each CpG in each tissue. As shown in FIG. 1B, each CpG was unmethylated in 90-95% of the DNA molecules from human beta-cells, and in 5-15% of the DNA molecules from other tissues. However when this information was combined and the fraction of DNA molecules in which all 6 CpG sites were unmethylated was calculated, the difference between beta cells and all other tissues became dramatically larger: while ~80% of DNA molecules from beta-cell were fully unmethylated, <0.01% of the molecules from any other tissue were fully unmethylated. Thus a stretch of 6 adjacent unmethylated CpG sites in the insulin gene promoter (comprised in SEQ ID NO: 1241) robustly distinguishes beta-cells from other tissues with a signal to noise ratio close to 10,000:1.

Figure 1C:
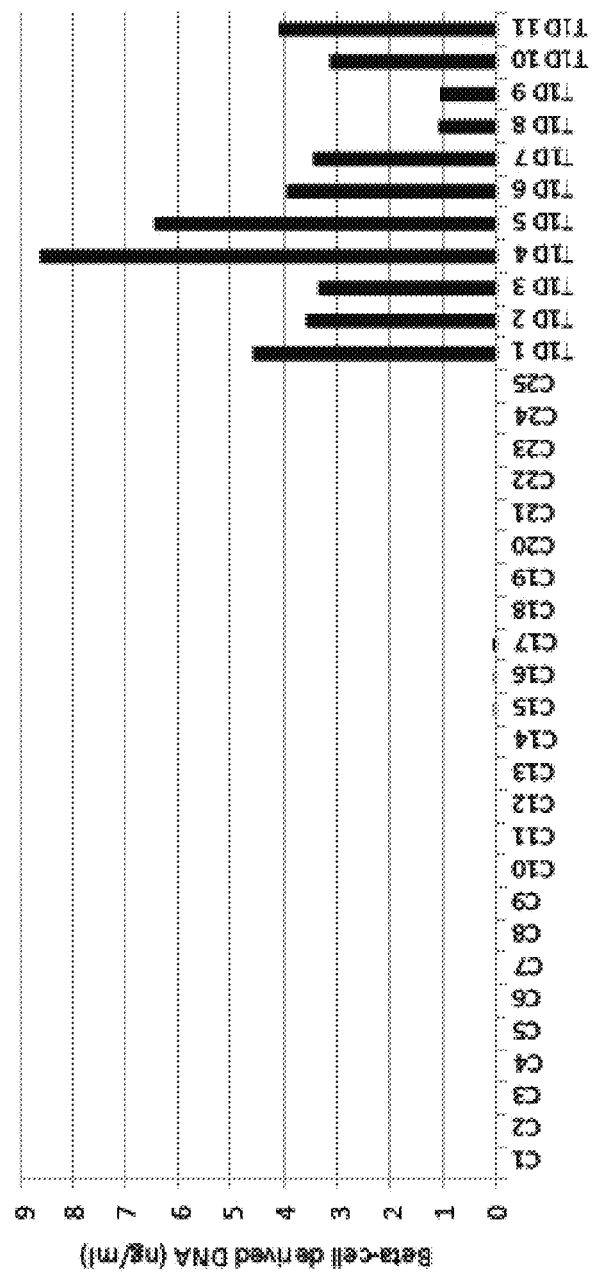

This information was then used to look for beta-cell derived cfDNA in the circulation of T1D patients. Plasma DNA from patients was treated with bisulfite, PCR-amplified and sequenced to determine the fraction of molecules containing fully unmethylated insulin promoter DNA. The fraction obtained was multiplied by the concentration of cfDNA measured in each sample, to obtain a value of beta-cell derived DNA (ng/ml) circulating in the blood of each patient (FIGS. 5A-B). The cfDNA of healthy volunteers (n=25) had an extremely low frequency of fully unmethylated insulin gene promoter molecules (up to 0.12% of circulating insulin promoter fragments). When multiplied by the total amount of cfDNA in each individual, it was found that <0.06 ng/ml of circulating DNA derived from beta-cells (equivalent to 10 genomes), consistent with a very low rate of beta-cell turnover in healthy adults (FIG. 1C). Plasma from T1D patients (n=11), sampled 2-16 weeks after diagnosis, showed a clear signal of unmethylated insulin promoter DNA in cfDNA (1.06-8.6 ng beta-cell DNA per 1 ml of plasma), indicative of ongoing autoimmune destruction of beta-cells (FIG. 1C).

Figure 1D:
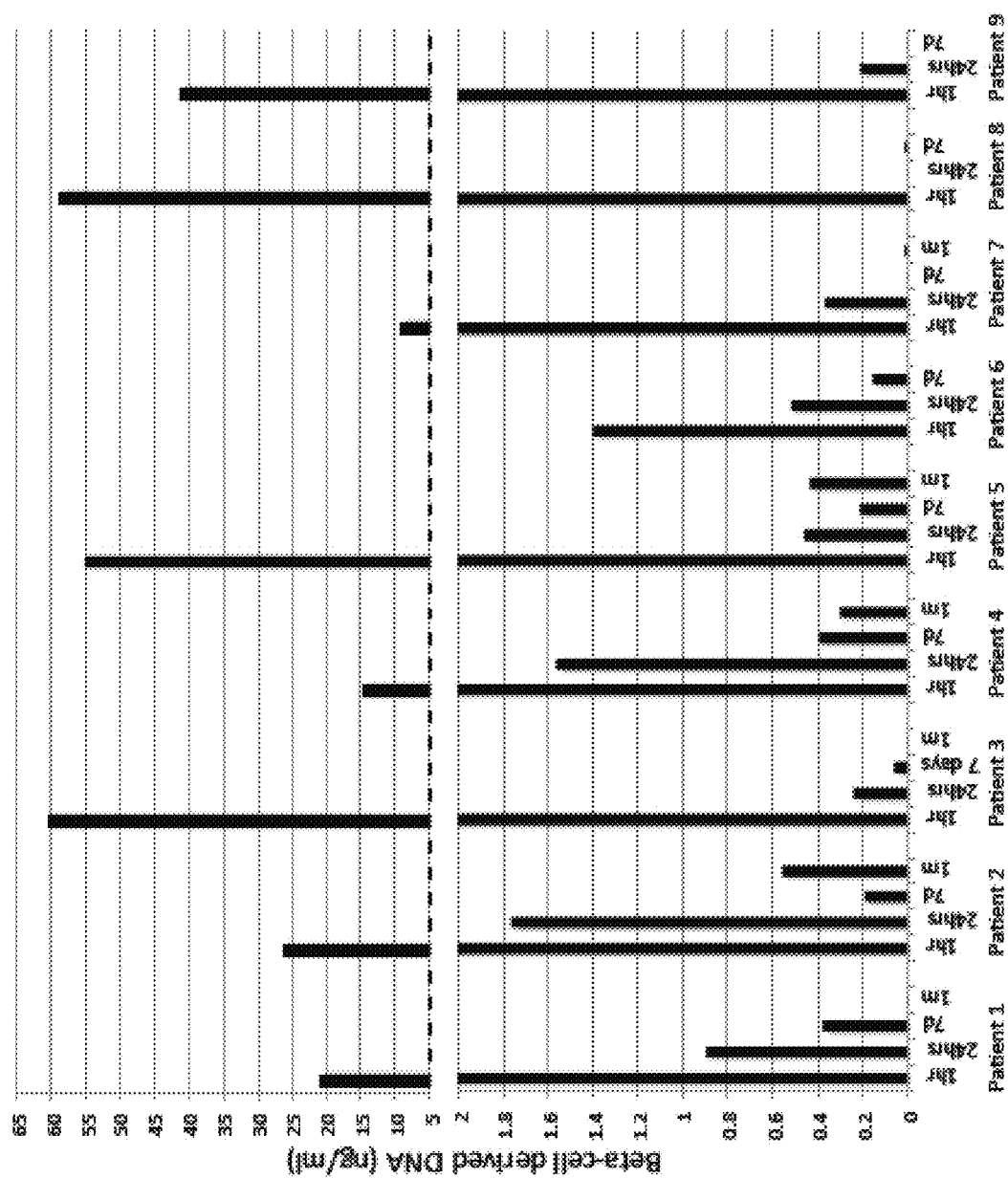

Plasma samples taken from long-time T1D patients transplanted with cadaveric allogeneic islets and treated with immune suppressants were also studied. As shown in FIG. 1D, the plasma of all patients had a high signal (unmethylated insulin DNA) 1-2 hours after transplantation, which dramatically declined in the hours and days that followed. The extensive loss of grafted beta-cells immediately after transplantation, potentially resulting from acute ischemia, is consistent with a previous imaging study of a transplanted patient. In most patients, signals clearly above background were detected at 7 days and even 1 month after transplantation, suggesting continuous, low level loss of beta-cells despite immune suppression.

To confirm that the combined methylation pattern of multiple CpG sites at the insulin gene promoter was necessary to detect beta-cell derived DNA in the circulation, the methylation status of each individual CpG in the plasma of healthy individuals and recently diagnosed T1D patients was examined. Each individual CpG did not have a different pattern in the plasma of healthy controls and T1D patients (unmethylated in 224~15% of cfDNA molecules). However collectively the 6 CpG sites yielded a clear signal in the plasma of T1D patients that was absent in healthy controls (FIGS. 6A-B).

These results support the very high sensitivity and specificity of this next-generation sequencing (NGS)-based method for the detection of cfDNA derived from specific tissues. With respect to T1D, the complete separation between the signal in healthy controls and recently diagnosed patients compared favorably with previous reports which demonstrated a significant signal overlap between healthy controls and diabetic patients. This suggests that it may be possible to use this assay to identify beta cell death prior to clinical diagnosis as well as in additional settings of interest, such as monitoring of efficacy of immune suppression used to prevent destruction of transplanted beta-cells.

Example 3

Identification of Oligodendrocyte-Derived cfDNA in Multiple Sclerosis

Non-invasive detection of brain cell death is particularly challenging. In theory, brain-specific methylation patterns can be used to identify brain-derived cfDNA. The present inventors looked for evidence of oligodendrocyte/glial DNA circulating in the blood of patients with multiple sclerosis (MS) and neuromyelitis optica (NMO), autoimmune diseases in which myelin-producing oligodendrocytes in the white matter and astrocytes are destroyed. The published methylome of normal human white matter was analyzed, and clusters of adjacent CpG sites were identified in the 3' UTR of Myelin Basic Protein (termed here MBP3) and around an un-annotated locus (CG10809560 in the Illumina array, which was termed WM1 for White Matter 1) which were unmethylated selectively in oligodendrocytes (FIG. 2A). As with the insulin gene promoter, individual CpGs in these clusters showed a moderate signal to noise ratio: they were unmethylated in 60-85% of DNA molecules derived from sources rich for oligodendrocytes (glial preps, white matter and whole brain), and in 2-35% of DNA from other tissues (FIGS. 7A-E and 8A-E). Combining all CpGs at the MBP3 and WM1 loci greatly increased the discrimination between DNA enriched for oligodendrocytes and DNA from other sources including blood (FIGS. 7A-E and 8A-E). Thus DNA from the MBP3 (comprised in SEQ ID NO: 1248) or WM1 (comprised in SEQ ID NO: 1247) loci unmethylated in all adjacent CpG sites can serve as an exclusive marker of oligodendrocytes.

Healthy individuals (n=19) had negligible levels of unmethylated MBP3 or WM1 in their plasma, suggesting minimal basal turnover of oligodendrocytes (FIG. 2B). Most stable MS patients (n=30) had no or very low signal. However most patients during disease exacerbation (a relapse documented both clinically and using brain MRI close to the time of sampling, n=19) displayed in their plasma unmethylated DNA of either MBP3, WM1 or both (FIG. 2B). This observation is consistent with the notion that short-lived circulating unmethylated MBP3 or WM1 DNA reflects acute oligodendrocyte cell death. Initial analysis did not reveal clinical correlates to the lack of signal in some relapsing patients. No correlation was observed between the signal in blood and age, sex, EDSS (Expanded Disability Status Scale) or disease duration. These results indicate that acute autoimmune destruction of oligodendrocytes can be manifested as increased circulating levels of fully unmethylated DNA fragments from the MBP3 or WM1 loci, opening the way to develop a sensitive test for the diagnosis and monitoring of demyelinating diseases. Additional methylation markers of oligodendrocyte can be developed to further increase the specificity and sensitivity of the assay.

Example 4

Identification of Brain-Derived cfDNA after Acute Brain Damage

To obtain a more general marker for brain injury, the Illumina arrays were scanned for loci whose methylation status distinguished brain DNA from other tissues. A cluster of 9 CpG sites around locus CG09787504 (termed here Brain1; comprised in SEQ ID NO: 1251) was fully unmethylated in 70% of DNA from various sources of brain tissue (enriched for either neurons or glia), and in <5% of DNA molecules from other tissues (likely reflecting DNA of peripheral neurons present in these tissues). Importantly, <0.03% of molecules in blood were unmethylated, providing a >2000 fold difference in methylation of this locus between brain and blood (FIG. 3A and FIGS. 9A-E).

Figure 3A:
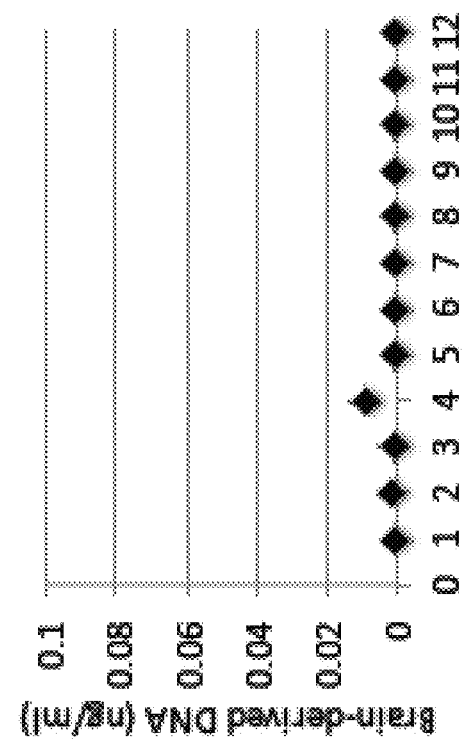
Figure 3B:
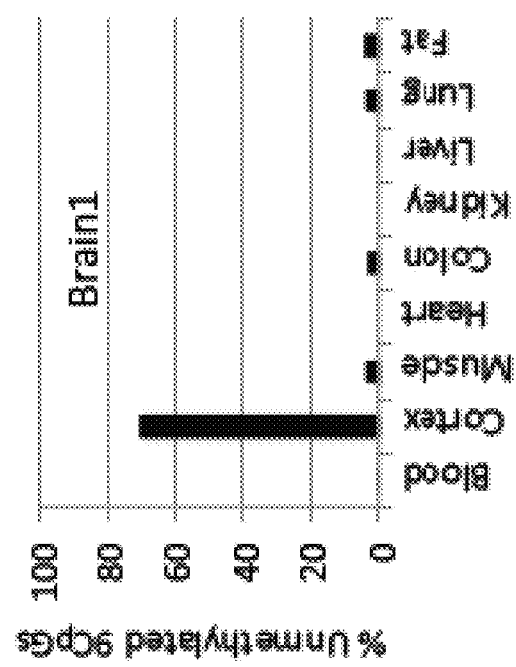
Figure 3C:
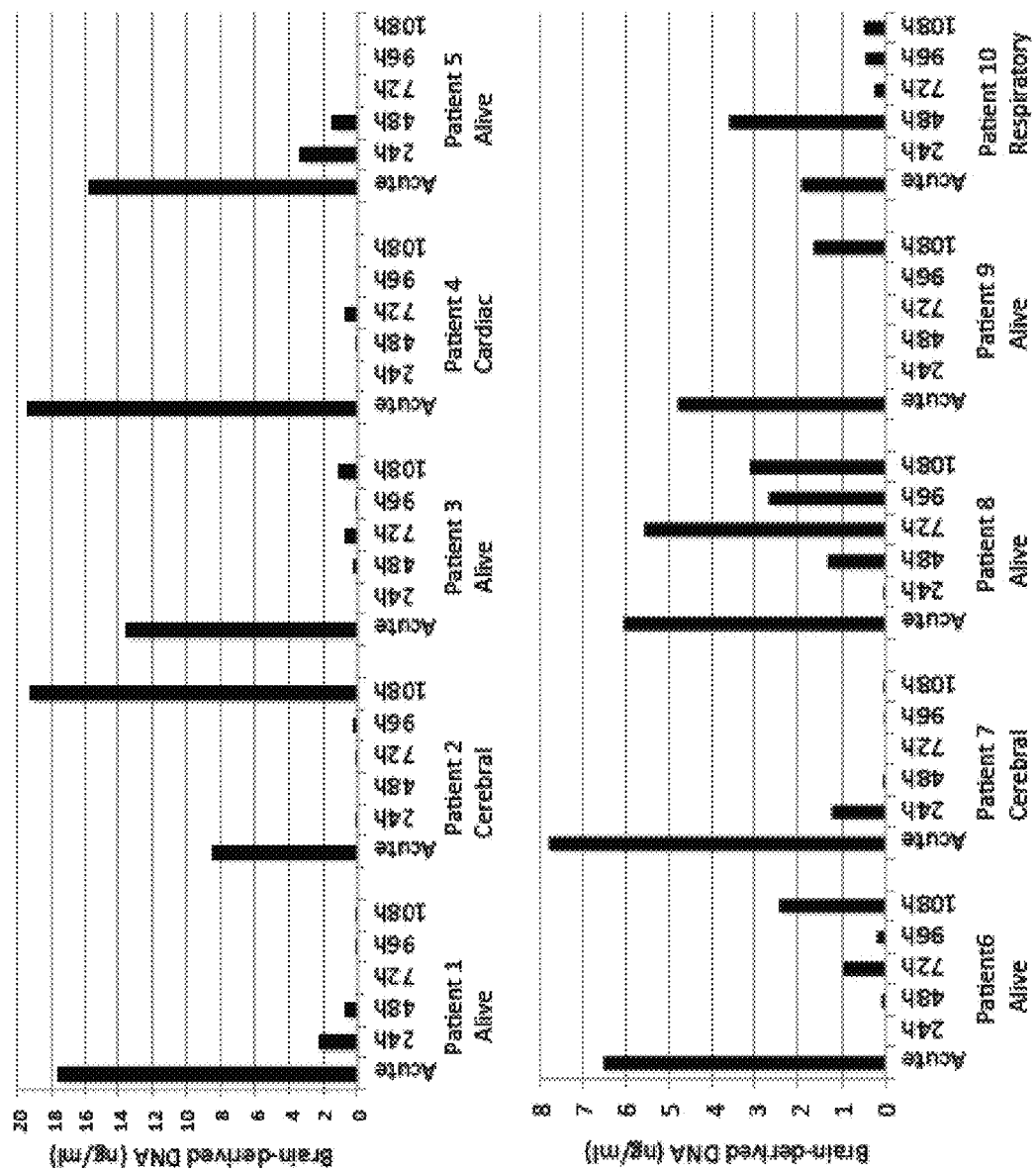
Figure 3D:
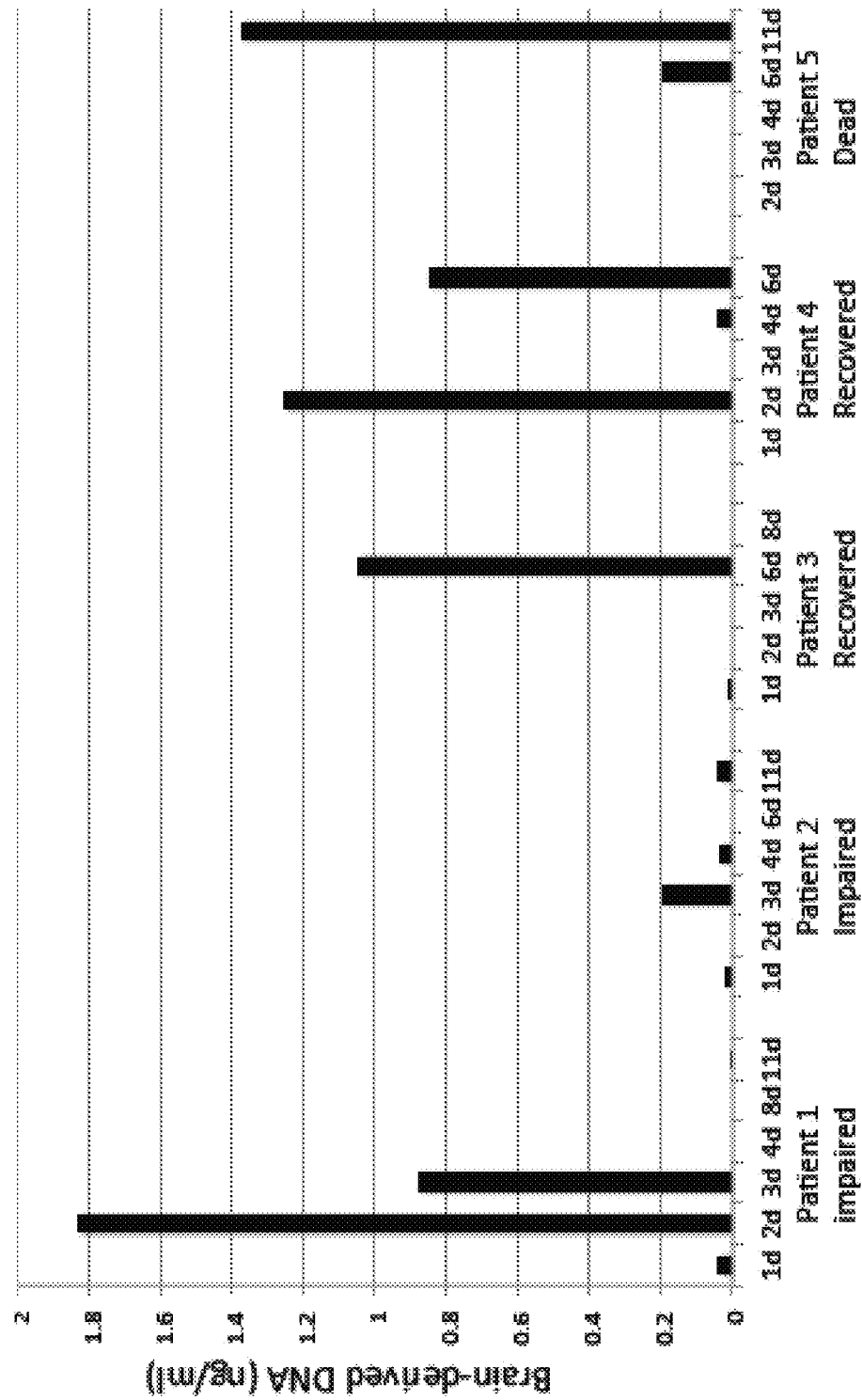

Healthy individuals had extremely low levels of fully unmethylated Brain1 in the plasma (FIG. 3B). This low baseline may reflect either neuronal turnover below the assay's sensitivity limit or an alternative mechanism for the clearance of DNA from dying brain cells. Plasma samples were examined from patients in two settings of brain damage, both known to involve neuronal injury in combination with disruption of the blood-brain barrier. Strikingly, patients (n=10) sampled at multiple time points after cardiac arrest with documented ischemic brain damage showed high levels of unmethylated Brain1 in plasma (FIG. 3C). Similarly, patients (n=5) hospitalized in an intensive care unit for neurotrauma after severe traumatic brain injury (TBI) had elevated unmethylated Brain1 in plasma (FIG. 3D). Both sets of results are consistent with circulating DNA fragments derived from dead brain cells (neurons and/or glia) in these patients. The amount and temporal patterns of brain-derived cfDNA varied between patients. In the group with cardiac arrest, the strongest signals were observed in the first time point, shortly after resuscitation, with a decline in subsequent days in most patients. In the group of patients with TBI, a more delayed pattern of brain-derived cfDNA was observed. These findings indicate that brain-specific DNA as well as oligodendrocyte-specific DNA can be identified in the circulation of patients with neuroinflammatory, traumatic and ischemic brain pathologies, based on unique methylation markers.

Example 5

Identification of Exocrine Pancreas-Derived cfDNA in Pancreatic Cancer and Pancreatitis The present inventors tested whether the approach can be used to detect cfDNA in the context of cancer. While tumors present extensive changes in the methylome compared with normal tissue, the majority of tissue-specific methylation sites are thought to remain intact in tumors. Thus cell death in tumors should give rise to cfDNA carrying the normal methylation patterns of the tumor's tissue of origin. Pancreatic ductal adenocarcinoma is thought to originate from either acinar or duct cells in the exocrine pancreas. Antibodies were used to FACS-purified duct and acinar cells from cadaveric human material and their methylomes were obtained using Illumina 450 k arrays (unpublished results). Analysis of these data revealed multiple CpGs that were unmethylated in the exocrine pancreas and methylated in most other tissues. Two sites were selected for further analysis and clusters of adjacent CpGs that could be used as markers for the exocrine pancreas were identified that could distinguish acinar and ductal cells from other cell types (FIG. 4A, FIGS. 10A-E and 11A-E). Healthy subjects (n=25) had very low levels of unmethylated exocrine pancreas markers in their cfDNA, consistent with a low turnover of this tissue (FIG. 4B). Nearly half the patients with pancreatic cancer (20 out of 42) displayed exocrine pancreas-derived cfDNA above background level (FIG. 4C). There was a trend to a stronger signal in patients with advanced disease, and these patients were more likely to show a signal above background. Nonetheless, some patients at stage 1 and 2 (localized disease) had a clear signal (11 out of 29), suggesting that this method can in principle identify cell death in pancreatic cancer at a resectable stage.

In order to further test the hypothesis that all etiologies of cell death lead to increases in tissue specific cfDNA, the plasma of patients with chronic pancreatitis was examined. Indeed, 7 out of 10 patients with this non-malignant disease had elevated pancreas-derived cfDNA levels (FIG. 4C). It was noted that patients with pancreatitis had a clearer signal with a marker (REG1A) that was unmethylated in both acinar and ductal cells, while patients with pancreatic cancer had a stronger signal with a marker (CUX2) that was preferentially unmethylated in ductal cells, potentially reflecting the epigenetic identity of dying cells in each pathology. In summary, cfDNA carrying methylation patterns of the exocrine pancreas is present in the blood of patients with pancreatic cancer and pancreatitis, reflecting death of exocrine cells in these conditions.

Example 6

Identification of Brain-Derived DNA in Plasma of Patients with ALS

In the neurodegenerative disease Amyotrophic lateral sclerosis (ALS), motor neurons die, followed by death of muscle cells. The present inventors tested if brain-derived DNA fragments could be identified in the circulation of patients with ALS. As shown in FIG. 12, 40% of ALS patients (n=29) showed measurable levels of brain-derived DNA in their plasma (based on fraction of unmethylated CG0978 [Brain1], multiplied by the total amount of cell-free DNA in their plasma), compared with near zero signal in healthy individuals (n=12). In addition, the present inventors looked for the presence of glial DNA in the plasma of ALS patients. FIG. 13 shows that 70% of ALS patients tested (n=10) had in their plasma at least of two glial markers (WM1 and MBP3), compared with no signal in healthy individuals. These findings are consistent with clinical reports on damage to white matter in ALS patients. In preliminary analysis the present inventors also identified muscle DNA in the blood of ALS patients (data not shown). Thus, the assay can be used to detect and monitor neuronal, glial and muscle cell death in patients with ALS, for the purpose of diagnosis, monitoring of disease progression and assessment of drug activity.

Example 7

Identification of Glial DNA in the Plasma of Patients with Glioblastoma

Glioblastoma originates from glial cells. The present inventors examined the plasma of patients with glioblastoma for presence of glial DNA (unmethylated fragments of WM1 or MBP3). It was found that 30% of glioblastoma patients tested (n=10) had a clear signal above the minimal level in healthy individuals. Thus the method can be used to identify and monitor cell death in glioblastomas.

Example 8

Identification of Colon Epithelial DNA in Plasma of Patients with Colon Cancer or Crohn's Disease The present inventors identified several markers of colon DNA, all having an unmethylated cluster of CpGs in colon that was unmethylated in other tissues. The tissue distribution of unmethylated molecules is shown in FIGS. 14A-D.

The present inventors then determined if these markers are present in the plasma of patients with diseases of the colon. As shown in FIG. 15, healthy individuals (n=8) had very low levels of unmethylated DNA from any of the four markers. This is consistent with the idea that cells that die during normal turnover of the colon are shed to the lumen and their DNA does not reach the circulation. In contrast, most patients with colon cancer had high levels of one to four of the colon markers in their plasma. This finding is consistent with extensive death of colon cancer cells and release of their DNA to the circulation, as shown previously using identification of tumor-specific mutations in blood. A single patient with Crohn's disease that was tested was also positive for a colon marker, suggesting extensive pathological colon cell death and release of DNA to blood.

Thus the method can identify colon DNA in blood in of patients with either colon cancer or Crohn's disease. Note that while existing methods for detection of colon cancer using blood rely on patient-specific somatic mutations, the present method is universal as it relies on colon markers that are conserved among individuals and apparently remain stable even in cancer.

Example 9

Identification of Lung DNA in Plasma of Patients with Lung Cancer

The present inventors identified and validated several markers of lung cells, which were unmethylated in DNA of lung epithelium and methylated in other tissues, and tested their levels in the plasma of healthy individuals and in the plasma of patients with lung cancer.

FIG. 16 shows the tissue distribution of unmethylated SFTP/A1, a gene that is expressed specifically in lung cells and is also unmethylated specifically in lung. It was found that unmethylated SFTP/A1 does not exist in plasma of most healthy individuals, but is present in the plasma of most patients with lung cancer.

FIG. 17 shows the tissue distribution of unmethylated SFTP/C, another gene that is expressed specifically in lung cells and is also unmethylated specifically in lung. It was found that unmethylated SFTP/C does not exist in plasma of most healthy individuals, but is present in the plasma of many patients with lung cancer.

FIG. 18 shows the tissue distribution of unmethylated CHST, a gene that is unmethylated specifically in lung. It was found that unmethylated CHST does not exist in plasma of most healthy individuals, but is present in the plasma of many patients with lung cancer.

FIG. 19 shows the tissue distribution of unmethylated RAB4, a gene that is unmethylated specifically in lung. It was found that unmethylated RAB4 does not exist in plasma of healthy individuals, but is present in the plasma of some patients with lung cancer.

It was found that the plasma of lung cancer patients tends to contain more than one lung marker. This feature distinguishes between plasma of lung cancer patients and healthy individuals.

Example 10

Identification of Skeletal Muscle DNA in Plasma after Exercise and in Muscular Dystrophies The present inventors identified and validated three methylation markers of skeletal muscle that are unmethylated in skeletal muscle and are methylated in other tissues (including heart). FIGS. 20A-C shows that tissue distribution of these markers (TNN, TPO and MAD1).

FIG. 21 shows that the levels of two of these markers (unmethylated TPO and TNN) in the plasma of healthy controls are very low, reflective of very low turnover of muscle at baseline (with one healthy control showing a signal, for unclear reasons). Three healthy individuals shortly after an intensive physical exercise all show a clear signal in both markers, suggesting that these markers can capture exercise-induced muscle cell death. Among 15 patients with Duchenne or Becker Muscular Dystrophy (BMD or DMD), 5 showed a clear signal reflective of muscle cell death. Thus the assay can be used to detect and monitor skeletal muscle cell death after exercise and in pathologic degenerative conditions.

Example 11

Identification of Vascular Endothelial-Derived DNA in the Circulation

To identify methylation markers of endothelial cells, the present inventors determined the methylome of human endothelial cells sorted from umbilical cords. FIG. 22 shows one marker of endothelial cells, which is unmethylated in endothelial cells (from umbilical cords) but completely methylated in all specific cell types tested (lymphocytes, and pancreatic acinar cells, alpha cells and duct cells). The DNA from tissue biopsies showed about 10% lack of methylation in this marker, reflective of the presence of endothelial cells in all tissues. Most healthy individuals have no signal in their serum, suggesting low baseline turnover of endothelial cells. The blood of a female during the menstrual cycle showed a high signal as expected due to extensive vascular collapse. Pregnant women had a signal, which was stronger in women with preeclampsia. All cancer patients tested showed a clear signal.

These findings suggest that the method allows for the identification of endothelial cell death in various settings, for example to assess the activity of anti-angiogenesis drugs in cancer or other pathologies, and in pathologies such as preeclampsia.

Example 12

Identification of Liver-Derived DNA in the Circulation

The present inventors identified and validated hepatocyte markers. FIG. 23 shows that the promoter of Albumin (ALB) is unmethylated in hepatocytes (and to some extent in kidney and pancreas) but is methylated elsewhere. The blood of healthy individuals contained either no signal or a relatively high level of unmethyalted albumin promoter DNA, suggesting fluctuating baseline turnover or clearance of hepatocytes. All hepatitis patients tested (n=7) were positive, suggesting that the method can detect pathologic hepatocyte death.

Example 13

Identification of Cell Free Circulating DNA Derived from Non-Lymphocytes

FIGS. 24A-B show markers that were identified as unmethylated in lymphocytes and methylated elsewhere. In blood of most healthy individuals, most molecules are unmethylated, reflecting the fact that most cell free circulating DNA under baseline conditions is derived from dying blood cells. However in the serum of healthy individuals, shortly after an intensive exercise or patients with cancer, there were high levels of these markers methylated, indicative of cell free circulating DNA derived from non-lymphocytes (apparently muscle DNA after exercise and tumor DNA in cancer patients). These markers can be used to assess in a broad way a deviation from normal in an individual: evidence of cell death in tissues other than blood.

Example 14

Identification of Kidney-Derived DNA in the Circulation

FIG. 25 shows that AQP (a sequence from one of the aquaporin genes) is unmethylated in kidney cells and methylated in blood. Healthy individuals do not have unmethylated AQP in blood (likely reflecting the shedding of dying cells in the normal kidney to the urine rather than blood). Pregnant women with preeclampsia (known to have kidney damage) showed a strong signal. These findings indicate that method can be used to detect kidney cell death in various pathologic conditions (for example, acute tubular necrosis in some patients with sepsis).

Example 15

Identification of Adipocyte DNA in the Circulation

The total number of adipocytes has been shown to remain stable during adult life, with evidence of considerable formation of new adipocytes. Thus, it is predicted that there must be adipocyte death at a rate that equal the rate of adipocyte formation.

FIGS. 26A-D show four different loci that are unmethylated in adipocytes and methylated elsewhere (here shown only for blood).

FIGS. 27A-D show that the plasma of most healthy individuals contains multiple methylation markers of adipocyte DNA, indicative of ongoing adipocyte turnover, consistent with continuous formation and destruction of these cells. Thus this method can be used to monitor adipocyte death, for examples to study physiological and pathological conditions as well as drugs that affect this process.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

SEQUENCE LISTING (1496 sequences)

SEQ ID NO: 1 - DNA, 500 bp, Homo sapiens
cggagagccataacactgagggccaagggtaacttaccatatttggcacgttggtgactgaagtattcttgatatctgtagggaaggtgggcaaactgttgaccatgctctgtttgctggctaactgggggttcactccagtggctcccattggctgccctccagcttgactaaagggctgtccaaatggacttgtgttcccagttattcccatctgaaacaaaaaagaggtaacatcagctgtggtgacgcagtcaatataaaaggaagggcctgggaaatgctcacacagtttcctatgaaatactcattgcaatgataaattcaaggttcattatcaggttcacatgctccaagcagaaggctcatgaagcagctcctagcagccactctctcctcaccctaaaccccatcccgcaagtagacgagctgtttccccccaccctcagccactctcctcactcaatccctcctgccccaacaatggcaccaacacccga

SEQ ID NO: 2 - DNA, 500 bp, Homo sapiens
gagaactggattctagtctaagctaaagtagtaaccggatgtaccaacttgggcaagttgtaaaaaccttccaaaccctgaatttctcatattgaatttaactaacaatgtcaggcatcacttattaggaggcaattgagagatacaagtgttcaatgcaagagaataaagagattgggggaagcttttgagagttgggattccagctgggcctagacaggtgagtagaattctaaggaaagggaaggacgggggattccgggaaaggaaaacaaaggccggagccatattgccaattaacgagatggtaatgggcttctggctaaccaagcattagcatctgctaaatgaggtgagccaggatgactaaggaagaacgtagatactacagaaggcactgaaggccaggctaaggaacctggtcattctgcctccattcactgggctgtttagtaaagggacaggatccaagaaccagtatctacattagccggcacatc

SEQ ID NO: 3 - DNA, 500 bp, Homo sapiens
tgacttagcttggctcaagattgctttatgaaccataaccagctcaaacattacaaacaatacttattatgattaatcttccagcaattaatctgagctgtattaacataattacgtggaaaagatctcacaatggaagacattcaaagaccacgccaaagtagaatcaggaggacctggctatggctcactgaccggtccaacttcttcacctttgaaacgaggtgaggacattattaactccactggcgcagcatcgaggtcttgatttacttatgaaaatgtaatcaatccaaagaacagtggctgacacatactgggcatctctataagttgaaggaatcaatgaatgacttcacctggatgccaactataggcctcagaagaaaagtgttggaaaatcaaagacagataagatgtagaatgatgacttagacattgttagagagtgacatcctaaagatcagaaacaacgctcagatttgtcaggggagatgatg

SEQ ID NO: 4 - DNA, 500 bp, Homo sapiens
agcaaagttgagcttttgcccagagttggcagctccccaagaatcagacttgtggagaacatggtaaacgctggtctgcttattttgggattgagggattgtgagggatcgtgcttatgtctccttccagaagtttaatgaacaaaatattaccattagtcaagcctacgtgaccaccagctgaccaggacacctgcagttctttaattaagctctagagatgagacatcccctaccctgtgtcccctacggagtagtgaccagacgagttaatttgccttgagtcgttaacctgagaggaccattagctctctgggaaatgattttaatgtgaacctactaccttttgctaagaaaaggaaggctctgtccctttcacacccagctcaagaggaacagccagtcttaagtcaaatgcccatttctctagtgtgaagagtaaagatgacagatgttcacaggcaacctcagttagttccttcccttgtcgaaaaatgctg

SEQ ID NO: 5 - DNA, 500 bp, Homo sapiens
caaataatacaaacatttatcttctacaggcaatgcgtgcactagcatgtgtgtctattgctgtctcctttctacacccatagcctttcccactctacgtgttctgtcgccgtcttttgattctttatccagaaaatgatgtcaccaccactgcccacatcccttaatctccagtgttcctccttgcaacgcctctcttgtcctcaaatatttttcacaaggtggtcctcagggtagggagcctactaacgagaagacatttcgtttacttgcttcaattatcccagagatttgaagaaaaggcacattggggaagagtccatgtcaagttctaaacacacttatctttccccttaaactggatcttccaagtgcagtttaggtagtctgttactgagagaaataatgcaggctgttttctgaaatgctctggatttccagaacttaacaccacagtagttcctattccttaaaacagaacttcatcagtcacaccttgc

SEQ ID NO: 6 - DNA, 500 bp, Homo sapiens
tgtactgactcctagtcctagtttcctgctctatttctataattcctgctctagaaattatattccttactagaaatctccacatcttttcatgaaagtatataaatctctgtgcctgtgtcagtgagcatgcatgtaaatgtctacgtgtctatctgcaagtatttgtaaagcatatcaatgggcgtttatggccttcctgctcgagaaacctctaggtaatctagttctctatgtcggcaccggcagcgaagtcagaagaagtctgagtgaattattaataagcagaattagccctttctccaattagatctattcctgggtcttcaggaaatggggcaaaataatcagggtggaatcagagtctctcagggtcaaacttggttccagctgcgtgtggtgaaagcaactagaggcagagctatcaagggctgtgacagatgagcagtggtctgtctgcaatgagcatgtgctcaagctaacatggataccatcttggt

SEQ ID NO: 7 - DNA, 500 bp, Homo sapiens
ggcaggataggaaaaggagctgggaacccggacctccggggactcacccccagactggaaaacagttggagaatggaaaaggccaaaggcaaccaagctgtgcctgagccatgcccagggctgtgggtgtgatgcagacccctaccctaacccaccaccacttgtgccctggcactgccatgccctctcccctctgtctctgcctctccatggcctctgagaccgacagcttcccctgcgtctttacagcgttcttgaccgagagtaacaccaggccctggatgggcagggaaccaggcaagtcatggtaatactgagcaaaatgcaatctttggtgattcagaagcccttccaagtatcatggtgtgtccaggtctccatgacaacatggaagggccttatgctcagaggctcaggagagctgtgtgggagatagtctggttaacagaggccagggtactccgggtctctgatgccgcccgagatcaaatcatagggct

SEQ ID NO: 8 - DNA, 500 bp, Homo sapiens
acacattccaactgtagcacctgcagtaaccatcagcagaaatcgagaaaaaatactcaagtagatttcttattccttctcttttcttacacaaaaagtggtagagtgtagatagtgcacgagcccttacctttctcccgacaggatttggggagagtcatcatattgtccgtacatggaaatctttctccttctttttggggcattcaggttgatttcagcccttgctatttatctcaaataatgttgcgtacaagtcaatttgtttgactttacctgtcattaggcaaatctctgagattctgttcatccacccagtgatggcttcagcagccagtgaatttcgatgtagaatttccgttggattctttttctgtttctccgctgagacttctcatttctctgatattttcatgccttgaaatctttctttgttcttcattgaggacagccttaggagctgccttgaaaatacgtgtctgttggcccagtgtctggtt

SEQ ID NO: 9 - DNA, 500 bp, Homo sapiens
aactctggagctacgtttacagcattttctaaaatcacaaacttagctttcaacattactgattttaataaagaaggtagggccttttggcacaagtaagtggcattacaaaaggatgggactcatgccacaaaaccggttttatttttccatctttaccttgtctatttgcctagtgcgaatacagccaaaattgggagaggagcataataaattaaacccatttcataatttgttctcatggactcccggtagttttaaataacagtccttaattaactttcctttctttcatttagtagttcactcttcttttcaagctctgccaggaaaatgaaaatcacagcaagtagaggtcagaattaaaatgcataggtttactctgggcactaacctatttatttggtttgtagtctccgacaggaaagagaatcttcaaatttcgggctcccccgaagaggtgccttcaggtcggtgctgcacgcccggtgtcacccttc

SEQ ID NO: 10 - DNA, 500 bp, Homo sapiens
aagcaggcaggagggtctgggatgatgggccctggtggaggggctgacactgaatggggtgacagaacctccagcgatggaggaaaggaggaaaggacggaagcgggacttaggcagctgtgttcacggtggggaaaagggggctgacgtcaaatgaccttgggaatgaaagagaaatgattcaccacagttgccagtaacaaccaagctgcagaatattaatttgcaattgaatcaactggtcactttcggaaacttcctgtcggtttttgcagggagtggcaggagctgaggaaggggtcggggtggcctgtcagggacctgggaccagcctggcaggttcagaagcaggacaggggcagcaatctatgtgcatcacacagaactgagatgacaaaccctgggaggggtaggcgggctgggaggagccagacagtggaggagctggaggtcacagtgaagacagattcagcaggagcgaggcttctggagagggtggg

SEQ ID NO: 11 - DNA, 500 bp, Homo sapiens
tatttcaatccgttttatgatttttgaaagccctgattatcattgtttacagtctcttcttaatgcacttcccatgcgttcttgttcagccttccaagagttggtttatgtaggccaccctctcccaacctcgctttacttttggactgctctcacgtgttaacccacccgctcacacctttaaaccagtttggggaatatttcaaatctgaggggggaaatcttgagcgacagatgacaaggagtattcgcaaacactccaggctaatgttgcttgtatttggtcacaggtgtgccctgcttttgcgtactataatatctctattggtgagaaagagggagaaaattatgctaaaaccacatggatagaaaggaaaacggcactgctgaaatcaggaaggatcagcattccttttctcctatacatacgtgtgtatactcagataaataatgataaatcacggcagtgtgagggaggcttttaacaaaatacaagcttc

SEQ ID NO: 12 - DNA, 500 bp, Homo sapiens
atttatccctcccagcagactctgaagcagaaaccctttatcagcatagtacagattagaaaacttaggcttagactggtagtaacagttagatatgggatccaggggctggaatttgcctcccaacttgcccacctgtgtacagtggggagaacaggtgtgacttgatgtcctctctctctgcaggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacaggtgagaaggcctcatggggctggggtaccctgagccagaggttgtgggagggacacagtctggcgtcctgttgtatcattcagacggggtgctctgaggggaaacataaaaagacgttccagggtatctaaatctgaac

SEQ ID NO: 13 - DNA, 500 bp, Homo sapiens
tgatctcatttatccctcccagcagactctgaagcagaaaccctttatcagcatagtacagattagaaaacttaggcttagactggtagtaacagttagatatgggatccaggggctggaatttgcctcccaacttgcccacctgtgtacagtggggagaacaggtgtgacttgatgtcctctctctctgcaggtcttctcagtacagcatggtggctggggcaggccgagagaatggcatggagacgccgatgcacgagaacccggagtgggagaaggcccgtcaggccctggccagcatcagcaagtcaggagctgccggcggctctgccaagtccagcagcaatgggcctgtggccagtgcacaggtgagaaggcctcatggggctggggtaccctgagccagaggttgtgggagggacacagtctggcgtcctgttgtatcattcagacggggtgctctgaggggaaacataaaaagacgttccagggtatctaaa

SEQ ID NO: 14 - DNA, 500 bp, Homo sapiens
agcagttcatccacaagctcgtgagcagccactggcagcactgcctccatgaggcctcgggagcattctcattgttttctccaggctgtgctgttcttcccctcagccttgagagtgaccagggatctcctaggcctagggaaacgccacctggtcattggccagagccgtttctagatatggtatctgacccctgtgtgagtaccgactgcccaagagctggcagtagttttgtactctgagcctgagcgtgtggccccacgttccatgaggcctttggccggtttgtttgccagagtgtctctgagaggagggagaatgttggtatggagaataattttattgctttcttctcaaaataaaggaaatactcaagggaatggtgggaggggaggggataaatatagcgtttccgatttcctgcttcctctactcttccacagcatttcacttttcatacggttagattttcatcctatcgacttcagctaaaaataatt

SEQ ID NO: 15 - DNA, 500 bp, Homo sapiens
ccagtctaaagcggtggatgtaaacacaggactggaagaaaccacgaacaacatggaaaggatttatatgcaatgggaataaatctgctttttaaaaaagtctaagaggagcctgcagaaggaaatctgcagcaggctgagccagccgggtgaatggcagaaagaatagaggctatttgaatactgatgtggccctcactttcttctatttccattaatgacatgctcatcaagggcaaacaatgggaccggctgccggcgcctgtcacagtgtgtgggtgctgggatgccaggctgtcatccccgggctgcatttagagacctgcacgctaataagaagtgctctgtgccgtcaatgcagacaggtgcttccgcggctgggacatgctccattcccttccccctgaaaccctcctctctcagcccccctgacagacaccatgaaatgcacaaattaacagccccatcatgttgggctgctgctgcctgcggtgaaagca

SEQ ID NO: 16 - DNA, 500 bp, Homo sapiens
atgggtaaacgttataaaacaacaattttataatctcattaagcatatcaacatccaggaaacatttgaaaaattgcttagccttactattaatagcaaatcaacacaacagtttttagatatcatgtttacgtattcattttgcaaagctgatttttaaaaacaacagccgccggccagtgctgcaaagaaatagccaggccacgcggctgacagtgtagcgtgcacagtgggcgccctgcagggctgcgtggcagaacagttgagcaccttatccgatctgaactgctgactctgtcctgaggaaactactggagatgtggacaaatatttggttcacagggatgtccttttcagctttgcttcgaaaaataagaaatagtttaattgtccggaaatacaggatgggcaaattaaagtatggccgtatgatgggttattgagcagccattaaaaccatgtttttcaagtatactcagtcatagggaaagttcatgatg

SEQ ID NO: 17 - DNA, 500 bp, Homo sapiens
aactgtttctgattgtggtaggcggccaaggcgtgcctggccaggggcctgggaagccctcttagctctcaggcttgggagagccagatggaggcttcaggggtggcccctctggttccagctggagtgcagggggccgattgcacttgaatacagctttcaataaagcttgtgaagttggggccgcgtcagtctggaaggtttctgaaggcgggtgtgcggtcgactagatgagtcctaaagccacgtcggagccactgggaaacaggattcagggtgacctgaggagtcggcttgggaaaggcacaggccctggggttgttaggtttggtttcacagagtctgtggcatacggttctggccttgttgctctgtggaagcacatgttgtcaagggagggaggtttattaaattattagtcattagctccattacgacttgtttgtgattgcagagggtggaagagaagtaccagcggaacctttttcctattttttctc

SEQ ID NO: 18 - DNA, 500 bp, Homo sapiens
gaggcctcctctcagctccgaggtgtgaaaacgctggacacagcttgtagatggacagcgggtagagcagtggaaaaagaaaactagaatgggatttcctatcttatgccaaattggcttgactcttaagatacatgtgagatgtccctacttaattgccggcataattaaattggtggaaaaaatccacaaaggacttgagattttgcttcaacagcaagtagaagcgtggccagctctgagagactccgtgacctgagtctgcagccctgggcttttctcccctcggacacaagcagcctctgcagcctccacttctgtcccttgccggagggatcggccagtgtgactcagccatctgttgtgcttggactccttaggacactcacgcgcacgcagacgcacgatcacacacgctactttcctgtttgtaggcttctgattatctcacaaggtcaagtgcaaatctgactttttacttcttttgttttgccacagaa

SEQ ID NO: 19 - DNA, 500 bp, Homo sapiens
atcagtaactgagtttcagggttgttttttccaaaaagatactaatcacacagagtgaaaggcgcgtgatcgtgtcaggtaacgcggcttatggacccgagactctgagcaaggtgcccatcaccgtgcggtgaggctgccagtggcgcatgctcaccaaaacctgctgtcccatctgcccaggacaggcacaccccatgtgcacaacgtcccaatatcaccctttccacccgggagcactgacacaggcgtccatcacctttgatgaatttaaagagtgcagacacagatactttttctgggtcagactggacaggctacgttttcattactagtcactttactaagaataacatcctctgggcacccaagcaaacagaacaattcctacatagtgcatggcaaacgagagcatcaataacaccttatgccgaaggaaaatacttaaggacagaaaatgcggccaaggactgtatttccagccaaactgactttgaagt

SEQ ID NO: 20 - DNA, 500 bp, Homo sapiens
gggaaggtcaaaggcacagagacgagaagtagaaatgtgtgtcctcagcctggtgtcgccccaggggttgggcgatctggcaggtatggcggaacctcgcctctaaactgtcttgcagattttctgtaatattggaataggccttactcatagttgtgcttgcccaatttggcctgtcattggatttgtgaaatggccttgaggcaatggcttaaatgattttttaaatctgtttttctctcatgtgagcgtctagaccgggaggcggccagaagtggccggcagctgtagagagagttttcctgggacacagccacgtgcccttgtctccatctttctgtggctgcggctgtaggatccacaaggctaaaatccgcataatctgccccgtgcagaatacgtgtccagcacgaccctgaatcagggactgtgtggggacccaggcctcctcccttcgtctgggagcagctgtcctccctgcacagagctgatgccaccgt

SEQ ID NO: 21 - DNA, 500 bp, Homo sapiens
aaaaatacaaaaaaagtagccgggcgtggtggtgcgcacctgtagtcccagctactcaggaggctaaggcaggagaactgcttgaaccccgggaggcggaggttgcagtgagccaagatcacgccactgcactccagcctggcgacagagcgagactccgtctcaaaaataaaaattccggtagagtaatactcttgtaacgcagtgtgcaattgagcagttgctgactgctgatttagagttgaaatccgactatatttatgtctagtcttggacagtggagaatatttcagcctcattaattaatcggtttaatttagcagaactgcagtcagtatttggaaacagtttgttatattaaaccctgaagtacttgaggctgcgcgcggtggctcatgcctgtaatcccagcattttgggaggccgagacaggtagatcacttgaggtcaggagttggagaccagcctggccaacatggtggaactccatctctactaaa

SEQ ID NO: 22 - DNA, 500 bp, Homo sapiens
ctctgcatgtcgcaatgagtttcagcaaagcctcaagttaaatggcttgtgataaaaatattaagcacattatgactgcaagacgtgatctcgtcaatgaaggaggctcttaattatttttgaagagaaatatcaacagtgtcagatttaaccgccaaactacttaatataacttccgcccaattttgcagatcatgatccgctcgattaacgggcaggaggtaatggatggagcccgccatgctgctccgggtgccgctgctgatgctggggaccgagccaggatggagggaggggcgtgcacaggagaaacctggaactttccctgggaatagaccctgcaggggaaagccctgtcccagcgccttctgaagtgggctgcaagctgcattcaaaggggcttctcaccccagactgagggtgggagcgagggctgcgaggctgcaccctggagatgcagccaggccaggcactcacttacgctgccaggcggttcacac

SEQ ID NO: 23 - DNA, 500 bp, Homo sapiens
gtggagctcgagcatccgggaatggcaagccccaaacatgtagttggggacagagatttagagaagaaaaaagaaagtctcctgacccgtggttcttgaacaatttcagtgggcacgtctggctttctttgtcgagtggaggctaagcttgcacgagttaattttgttttcttccgtgatttttttttgaaagccgcagggctgcacttggcgagtgctagaaagacggccacgtttgggatcgtgggccggatggggcctccgtcggccaggcccagttggccttagccggctgggtcacaaaatggaagtgtgaggaaaaatagagcccagaagaggaagggtctgtccccaaagggctaagggagaggccatcgagagggcgatttgggccaatatttgtggtttcccagtgtctgctcctccccaaattccattctcagatgaacttgggagtggcccgtaggttgtgggagagtctggcctgacttggtgaagcc

SEQ ID NO: 24 - DNA, 500 bp, Homo sapiens
agtcgcggggctcccggagccgctgggagggcagccgtgtgagatgcggggctgcgagcgtggaaacactcgcagtcgccagtgctgaggcatgtttcagccggggcggaatcacatgcattaattattgtacagagatgtctttagtagaaaatgattttgaaattcagtttaatttcattgtaatgtgctgcaaacaggaagggagtatgtgtgtttaattggctctcgggggtaaggcctggaagccgcatgtctttgtcacaggccattagcgatgctgctgcataatgagagcctgcaatcagctcacagctgccgctcctgccgggagagcatgatattaaatagaaatcaggagaaattaaacttaaccctttccctggccagcccctcctgccacacggattctggcataagccggcgggcacaggggacagccagggatggctggacacagctgaggatggccgaggccggcctgcagctccccaacggcc

SEQ ID NO: 25 - DNA, 500 bp, Homo sapiens
gttgccatggagacctcatctctcggattatttgaatttcattatatctattgatttgggagcatttcatcttttttattgtttttctgtcaattttcaaaacgaataaccatctaatttgcgtcagtgctgattatgtttgtccctcaatagaggtcggcagctgcgctggggaaacaaatcaatgaaaaaccatcataaaactccccactccagtctccaggatgtgtgggtgacattccacgcctgcgagagacacactcatcagctccaacttcggcgacggtggcggcggctccgttccacgtccgcctcctttggccttaatatttaattttgcgatttggggcattattagtggtgtttttattagcgcgtgtgcctgtgagtgtttggaggtgggctggcggttccattaatttgtgggtgaggcagggaagccccagaggaaggcacggtggacggcgttggggtgcagtggcgagtggagaaaagagggg

SEQ ID NO: 26 - DNA, 500 bp, Homo sapiens
ttggagcccacaggtgctgggccacctgggcagggctgtgcaggcagtcacagaggctcatctggaaggggagccctctttccttgttcgtggagtggagtgtgcagtgggtcacgccggcctggccgggcacggccaggcgattaggaagccggcagcccgcgggtgatgcttccgaggcaccagtgactcagtccacaaacgtgggcgtaaaaggcctcatgattcaggtggagtgatggtgcgatgcgtggtgcagtgataagtcctcctgcccgacgccttatggatcatctgacatttccagaacgcagcctcttcattaccggtgcttgtaacgatgaattaaaaatccttttacacgaggcccgcttgtactgcttaatggggctttgcaaggaggcggcggttaattcctgctcgcccaaccgcccagccaccttcgcgggccacgggcaggctgcaggcatggggcactcactcctggttacccatccgtc

SEQ ID NO: 27 - DNA, 500 bp, Homo sapiens
gcagcccgcgggtgatgcttccgaggcaccagtgactcagtccacaaacgtgggcgtaaaaggcctcatgattcaggtggagtgatggtgcgatgcgtggtgcagtgataagtcctcctgcccgacgccttatggatcatctgacatttccagaacgcagcctcttcattaccggtgcttgtaacgatgaattaaaaatccttttacacgaggcccgcttgtactgcttaatggggctttgcaaggaggcggcggttaattcctgctcgcccaaccgcccagccaccttcgcgggccacgggcaggctgcaggcatggggcactcactcctggttacccatccgtcagtttgtctccaggacttctccagccaccggctcagggctccaggcagtcctggtgagtcagggggctccggctggccgcccgcctgggccaagttatcaccacgttctcaaggccgtgctgctgagaagcttctcacctaccggctgggcagg

SEQ ID NO: 28 - DNA, 500 bp, Homo sapiens
gcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcacttaaaacattacctggtcatctggtaagcccgggacagtaagccgagtggctg

SEQ ID NO: 29 - DNA, 500 bp, Homo sapiens
gcagggctgcaggagggccgggagggctaatcttcaacttgtccatgccagcagcccctttttttccagaccaagggctgtgaacccgcctggggatgaggcctggtcttgtggaactgaacttagctcgacggggctgaccgctctggcccagggtggtatgtaattttcgctcggcctgggacggggcccaggccgggcccagcctggtggagcgtccaggtctgggtgcgaagccaggcccctgggcggaggtgaggggtggtctgaggagtgatgtggagttaaggcgccatcctcaccggtgactggtgcggcacctagcatgtttgacaggcggggactgcgaggcacgctgctcgggtgttggggacaacattgaccaacgctttattttccaggtggcagtgctccttttggacttttctctaggtttggcgctaaactcttcttgtgagctcactccaccccttcttcctccctttaacttatccattcac

SEQ ID NO: 30 - DNA, 500 bp, Homo sapiens
cctccccgcagctgttctggcccgtctggcccctgagtgacagcgctgcctggggccgaggctgggggagggggtcctccctgctcctgggccccaaagtgctggctcgaaggagaagggaccccatgctccctctgggtcctccctatactgcccctcggccccctagccccagcctgcagcgctgcggaagcagatcagtaataaaaatgctccggatgtgcaggagataagggcgagtttggaccccgttccgccgacctcagcccccgtccagcccgttccgcaagcccacctttactccccatatcggctccgagtgagaggctggggacaccgctgcttctcggggattttgcccacttcagtagaacccggaggacaggagtagggggggtggggcccctttggacccagccaatggctgtccacagaggtggggacaattccaaaattggaaccgtcttgtaaacagccaaaagcaatgatgtctttaacca

SEQ ID NO: 31 - DNA, 500 bp, Homo sapiens
tgaaggcgcggacaggggggtcaaggtccgagggatggccggaaaggatgaagtgggtcgggggacgctggggaagacggtgtggaagtgagtcgtgggtttgggggttggggagaaaagttccgggccgggccgggggtccccacgagagggtcatgggcagggaaacgcagccggggctgggcgagggcgctgcgggcgcaggtagggggcccggggcgcgtggagagcgagttccgggcgcgagggcgaggcggaaggctcagctggccgggccggcgggggtcggcgggggtggctcggccgccttggcgcaggccgcctcgcagtgcttgtggaggtaggacttgagcgcgaagctcttgtcgcactggcggcagcggtagtgcttgaaggccgagtgcgtctgcatgtgcgcgcgcaggttggagcggtcggcgaaggccttgccgcagtgcgcgcagccgaacggcttttcgccggtgtgcgagcgcatgtga

SEQ ID NO: 32 - DNA, 500 bp, Homo sapiens
atgcacgaccacgaggtgacggcctctcgctaagtcctcagcacacaactgtctgagccgcgtttaccgagagagtgaattagcatgacgacgtaacacctgtttttctaatctttgaacctaggttggagccggaacgctgctccttcactccccctcccgggcccagggacctggctttgcaccctccccacgaccccgcctgccagccccccacgcgccctgtagccggaggcgtgaaccgtgaaccggaacctcaggtgcctcccacgtgttctgcgaatttacgttcgcctctagcacgggaaattttaaatgaatttcttgaagctcagagactaatcgttttgccaatataaggagaaaagccccagaaaggaagagacggtcacgggcgacccactaaccccaaatagagatccttatagagtctaggccgccacctccttgagccggtggccttaaaacctagcctctggccctcaggcacccagaatgcg

SEQ ID NO: 33 - DNA, 500 bp, Homo sapiens
ccgctcgggccgggtctgggctgcgtgtgtcagtgtgcgcctggggacgagggcggggccccagctgaagcctccgagccacacatgcacacttgtgggttcctgccgagttgaagatgactaacgcttgccagatttgggaaagggaagaaggagtttagaaaaacaaaagttatctagaaactaaacatacccgtatgtcctgcaggcctggcctattttagcagctgtgctaaaacagcccccatgcgtggttcacaaacccaagactaaggattccatgggaggtgacggcctcctcactcctcactccaccccacccctactaccacaaacactctttatgaacttcctctttttcttctaaagaaacctgcttagttttttttttttttttctttaaaaaaagccaagccaaggaaaggccggagtggggagtgggaggggatagcaggcctctttgggagtggaaagttgtacctcaaaatatttcagcccac

SEQ ID NO: 34 - DNA, 500 bp, Homo sapiens
gagcggtgacaacgatggagcgtcctcggagagggtgggctgccccctgtcactcccgggggaagatcgccctgccctccgctctaactgcgtggttgaaaccagtttcgggacccgagtcctggtcccgctgacgcgggaggcttgtttctggtggggcagtcttaacgcattgccttcagatgcctttgagagtcaggacttgctctttcttggggatcctccgaaaccagcatgccttcctgcccacgacctaataaagtgggactttttcaagtaccccttgggagtggacgtgtaacacgtggtcgcaaggatcccggcgcatctctacgcagtatatctaatggggatgggggggctctgtttgaaagcaaatgatttgcattttaattgaaaaataaatgaaagcggtttggcaaattctgaggttgcaaaaagggtttaaagggtggcggtgaggaaggttctgtgctcctcgactttgaggctggaaacaa

SEQ ID NO: 35 - DNA, 500 bp, Homo sapiens
gaggccagctggagggaacagctccggccagagtgacaactgcagcagcagcagcgaggccaacgggacggggctggagctgctgggcggcccgtcgctgcgcagcgcctacatcacctccctctacttcgcactcagcagcctcaccagcgtgggcttcggcaacgtgtccgccaacacggacaccgagaagatcttctccatctgcaccatgctcatcggcggtgagcccggccgcgcgcgtcttcccggggccactcccagacttctgcccgcaggcggcgccgtcccactccccggagggcctgaggccgggggctcttccgctttaggtggccgcggaacccgaggccgggggtgggggagacttcgcccgcacagcggccttcaggccttgcctaggagcgtgcgggccgaggacagatgagcccagcgtggtgtcaggccgggccaggtcccctaggtgaccccctctcgtcaccctcccccagccctgatgc

SEQ ID NO: 36 - DNA, 500 bp, Homo sapiens
ccccggagggagcggagggcagctcatctcagagcgcaggaagcaaacccgccgccgcgacctctccccaggctggggtgggctggcaggcggaggtgggcagtaaacagtcctattgtacaaatatatagcgcgggctgggcgggggcggtcaaccccggttccctggcacggggacagggcgcgctgggcccggctctgcagcgagccggtgggagggcctagctgtggcccaggcggtgttgagcacgggccgggggcgtcatagccggggagggccgggcagcgagcgggtgggcgaggggcgagtcatcgtctgccccgcccggaggggaccccggcgggtgagggacgtgggtggagggagacgtggggagctcagtcggagtagatgatgaagccagagaacgtgctgtatttgttgctgttgccgccgtgtgctttgcctccatccagcttgatgaagacctcgtcgccggcgtccaggtgcaggatcacgc

SEQ ID NO: 37 - DNA, 500 bp, Homo sapiens
ttgctttctctgaaggttccctaattttctgagaaagcaattcagcaatggctgaaaccaagacattcaattagtcgctcatttatcagttagtcagcactcccatcctgtgaccacacaacctgggctgccagctcatcaccaagtctctgaggatgcagccaccaccttcgtcggcttccctcagcctccaactcagcaagacacaggcagatccatagcatggctgagctgtccttggtgctgaagcggcatccgctggctcttacctctgggtcctgggctgggatgggctacttcttgatttcgagaggctgcaaacattgttcccaagaagtccccaggacctggggctggattattgggagcagaaactcacaattttcccatcgtgttctatgctggcctagcacatctagagccttgcctctcttgtagcctgaacaccccttacacagcttcgcaggggcaaggtgaggctgatgcaacccaggaattgg

SEQ ID NO: 38 - DNA, 500 bp, Homo sapiens
acttgggtcggcctcctgaaatgacagcagggagacttgggtgaccccccttccaggcgccatctagcacagcctggccctgatctccgggcagccaccacctcctcggtctgccccctcattaaaattcacgttcccaccctgtgtccacttcatgattcctcgcaagctgggcccagtcctctcatcccaagagcagagccaccgtagccggagtcctagcctcccaaattcggaaatccaatccaacggtctcaggaatgttttccatcccgccacgcgcctcccgaagctcccagaccggaggctcagcccccatctcggttagtgcccctctcccgcccgactttagagccagcccctgccccttattccctgccccaggatcccggcccctcctgggagctgggctggactcggtcctcagatcctcggaaggctcagctctgggcggggcaagggaccttgcaagtcgggggggcctcgggaacttctctccg

SEQ ID NO: 39 - DNA, 500 bp, Homo sapiens
tgggcaagtgagtcggcgctggccccgctcccactgcccgctctgctgtttctctgcctgcatgctgtctgcccttgtcacccgagtgctggttctgcacagggtctctaggccgggtcaggcccagcctagcgtcagctgcgattccctgggagggacccggcatgatttcccgcagaatttgcatttcatgaggcagcagccagggctgcagggaggaggggcagcgccgggcgcggggccacataccggcactgcccagggtacacacacctcaccgaccacgcacgccgggcaggggcgaaagcgctcacgggagggatgccctgcacgcagcaagtgctcctgtcctgcccaggggcgaagaagtctcctaagggtttgctgctggcggagggaagcctgcttcccgcttctgccagctccagcctcagttcccgcccgccctccaggcagcgggctgtgaggacgctctgggccaggctgcagcgcgagcgccc

SEQ ID NO: 40 - DNA, 500 bp, Homo sapiens
ctggaaagcttcggctggggcctgagtggacgggaaggcggcggcctccgcgggatccttcccggggccgatccacagtcaggatccccagctccaccgccatcaagtgggactggagttcggccagagaagaaaacgacttcgggaactggcaacgagggagagggaaaagttgagaaacgtgactcagcctctttagttcatctttcacgtggggcagcggaggcctggcggggacggggagccgctcggggactgcaggcccgtaggtcgctccctatccgtgagggattggttggttccaggacacctgcggatcccaaaatctgcggataatcaagtccctgttataaaatataaaatgggctgggctcggtggcttacgcctgtaatcccagcactttgtggggccgaggcgggaggatcacttgaggtcaggagttcgagaccagcctggccaacatgatgaaatccccgtatctactaaaaaaatagaaaaa

SEQ ID NO: 41 - DNA, 500 bp, Homo sapiens
tggctcatggctctggaccggcgagccgtgcgggtggagatgggcgccggctcctccgcggcgcgggcgtccaggcggtgatgctcccagcgagctccagagggcgctgtcccctcggaggcgcgggcgctgcggcgggaagcggcgcagcgagggtcttcccccccaagacacagttgtttctgacacataggaagaccacaagtttacaaatgcaaacgccgagggcacggggcgatgctggctccacgtccaggcgatcttccctgccgggccacagctcaggaaagcccggctccttgctccagaccctgatcaggctgcatccactcctgctcggcagcttcaggtttgtttttctcttgtcaggtttgtgtgttgttgttgttgttttgtttttgtctttttaaaaaatttagggagcggggccaccacggggaagggagaagggacgtggctcctggcgctacattcgggagggcgggctggccagttcgtag

SEQ ID NO: 42 - DNA, 500 bp, Homo sapiens
gtcttgggagcccctcagcctcgccctccctgcagggagaaacctgtctactgcgtgaatttctaagcagctgatccttcaggcccaagactcctagagtggaaagggttccccggaatagtaagcgcgccgtcaccttgggtttcttcttcccagagcaaggagacccccgttttcctcatgacccgcgtcctaaaaggtggggaggtgagattcactgggaatcgtgaacctgcccccggcttctcccggggcagcctcccccggtcaggggaggagggagcccttcccttcaaccccgaaaggttccttcctggtccctagctttgctctttgcaggcagggatggggctggcacgccttgcggagaattttaccgttttaaatatggacctagaggccaggtcggaaaggggaaagaagctgcgccttgccgagggtcctgtggccggagcagggcctgactcctgactcccatccagcgccccttctagaaattg

SEQ ID NO: 43 - DNA, 500 bp, Homo sapiens
tgtaagaaagggtgaaggatccagtatgggagatggagattgtccatatcccgagggagggactggccagggcacacccgccaagggcaccttgtgtccctgctctgcagagaccgcccagctctaggtgcctgagtgttttctgctctccacatttgaaaccctaacaaaacccctgagcaatcaggccgtgtggaggcaaagagcctctcctgtaacagtgtggtccttccagccttctctcacatgcggaatttggcagacagtgatgtgagacgctcacatggcaaactttcttttctgtttctctttggcacaaagcctcagcgctcccgcgcctgccctaccactgaacaaaacagcctcttccgggcccagctcacttgtgcctccgcccacctcgctgcgggcaacacccgttttcctaaagattgacaagaggacgtgttactcaaataaccacccgctcagaagaaaaaacctctgtgcagagccttttg

SEQ ID NO: 44 - DNA, 500 bp, Homo sapiens
ctgcagagagcgcttccttccgccctgtccagtgccctccctgcctcacccctcttcccgcaggcccgctcagggcgctgaagggctcctgaccgtgggtccgtccttcgctgcgtctggggggcgtcccccgcgctgcctctgacccgcccggccctgcgtttgtctgaagcccctcgttccgcatctccggaccagggtccgggggcgtggtctgctgggggcgggcccgggttgtggtttgagagccgctcggcctgtctgggcctccgcctccgggtcgccctccagccttcctgccgccgcttttccagtcttgcccaacccggtatttctgcgcttgcctcagccacccgcaggagcgcaggccgcccttcgtcctcccgtcctctgcgcccacaggaccccgggccccgcccagtccgcaggtcccgcaggtccccccgggcgtgtcttcctggccctgcgacccccgggacagcgctgagaacacgcggaag

SEQ ID NO: 45 - DNA, 500 bp, Homo sapiens
cctccaggctgagcccctgggggattttgaaaggaaacaggctccatgtgcttccaatccactccacgcagctcattgcgctattgttccgtctagcgggggatgtgcgggacaccctggaaccgttcgtggctctgtttaaagatgtttttcttagaagcaggaagttacgtcctgccaagaagaaatgaaaataaagccccgagggttcactcggggttcgctgggagccgcgctgagctgttgcagcgtcttggcccggccgaggaggaagtttaaaggggcctctgtctagagctctgaaggcaggcaaggcagcctggcagtgaccatcaggcaagtcagagacacacgcgagctctctgccccaggggccctagggtggcctcacagggcacagcagagccctccttctcgtgatcacgctgcggtcgggttggctgctccttcccattcgttcctctgaatctctgcagaggccgggggcatgtgggaagggc

SEQ ID NO: 46 - DNA, 500 bp, Homo sapiens
cttacgggaggttccctgaggtggagtttagatagtatattggattccccagagagcccatggtggtgagctggaaggggctttggtttcccatcaaggcattctcaccaactctccccaagagcggcaggagggctccatcatcttctctgatgtattgatcaggagagctccagaggtagacaggctgaagctggaatactgccctgtccctgacacctgctggggtgttctggcggggcccggaaacggaagccctctcctggctttgttgggtttcctggggaaggcggagctggtccacgggtgactcagcgtcctgcacagagtccaacccctggcccagtccgtgtgtgtgtgtgtgtgtgtgtgtgtgtgtgtgtgtcctatcctggccttgggcaggaggaattggcccctcatagagtgtcagccccatctctggggatgtggagtaggggccacatctgtgtctgcctctgcctccagggcacagcact

SEQ ID NO: 47 - DNA, 500 bp, Homo sapiens
cgtgtctcgggtttgaatgaacccttgaggtgaagcttaaagacagagaggatgcccctgattcccaccccagggacccacattgtaaacccccacctgctctgctgagcccttggcctcagcatggaccctgaccatgtgctggtggggaccccccaggtaagtaagcagcctctgaggaccccggatgaacagtggggaacagcactgatcccccagtggggccccgagttcccggagaggaagactcgctccctcccaggggacggctagagactcactgactcatgcgtgtgtggtaggaatcttccaggaagtccccgtcccgttcgccctctctgcctgggcggggacggcaactgcctctgtcactgcagactaatgggacggaggggggtgacttctcagggttcctcctgggcaggtgctccggaaccttttctcagcacgctggcctggggcacggccgttcctcctgcccagccacgttggggtacagg

SEQ ID NO: 48 - DNA, 500 bp, Homo sapiens
gcgtcggcctgcctggaggaggcggcccgggagcgcgacggcctggagcaggcgctgcggaggtgagggccggggtggggtatgggggccaatggagggcctcagggcagcagcagaggcggtgccagggggctgtagcgctggcaagttctcatccggggtcgcccggtcccccgaaggcgcgagagcgagcacgagagggaggtgcgcgctctgtacgaggagacggagcagcttcgggagcagagccggcgcccgccgagtcaggtgggcctcgggccccgcccctcccgccaggcccaatcccacctcgctggcctccctggctccgccttctctgaattaatccctccccgacggccccacctccgcgggtccaggctgccctcagcccgaggagatcccactgggcctcacgtatcacccccgtccggtcttctccacccgaccccgctccgcccgggcccactcccagcccctggccctccgtgtacctcttt

SEQ ID NO: 49 - DNA, 500 bp, Homo sapiens
cctcgcatcttcaccttcaatggccttaggtcctcaacttcctctctccccccactccctcccgccaggactcctggagagactaattcccagatgtaaaacaagaaactcaaatccagggcggggctgcgtatagagcaggcccagtaaggggcccccagagtccccgccgtccgaggcgagagcggacgcggccacaataaaggcatcttattgggacaggaaatcgggattttccgagtccggtttcgaaattgaggccttgtagacgcttcacctttcctgcccggctacgtgctgggctccggagggcagtgggagtgcggagaagcagctccactccccagccccaagtcttgcgggcagttcccgaagaaaagatgggtttggggcggtcgcgaaagcggcgcctcgcgtgttttcctgccgttcccgggtccttatagcccggccggagactccgctgagttgactcggcgcccggggtcctgccaggggta

SEQ ID NO: 50 - DNA, 500 bp, Homo sapiens
ttccccataatttcaatcccaatcccttcaagccagcccagcaaagagcttcctggtttctggtccccagagttaagttttagggtcagaagcaagggaaggtttgggtacaaaggtgcacctggcaccaaaggcggagcaacctcagcggcttggatgaccgttcctgttgggcatagtttccttctggataaaacagtcgccaacctcgtttttgtggtttctgtctcttggtgagatctagggtaacgactgagatggggactgtggggagacgctgcttgaagagccagccgtcaaaagggtaatttagcgactacccgtggagcgctggtggtgaacctgggaatcaattgcaatcgtctggcagagttggccagcagagatcagccggcgtgagtcagcgccggagggtgaagcaggtggcagtagccagggtctagtgattgggaagcccgctgtgtttggggagtaattcccccggttccattgccggctgg

SEQ ID NO: 51 - DNA, 500 bp, Homo sapiens
taggcaagggagcctaggagcatttagttccaacggggttttgtccaataaggaaggagcctcatcctctccctcatccctgctgttcacagaattagagtttagagttgaaaggaatatccaggctaccttctcccccaatttttttttcttttgagacagagtttcattcttgttgcccaggctggagtacaatggcgcagtctcggctcacggcaacctctcccaatttttgagctgaaaaaaaaccgaggctcagaggtgtcaacttcccgaagctcacaaagttaatgatcaatgtccatataaagtcaggtcttgcaattcacaaagttcttggcacactcaaattatttacagcctagttttgatctatgccctaaagggagccaggtggtctcaatccaggtgatcaggtctaggctggggcagggggacaatcccccaagacagaggacccctatcctgaatgtggatttgtaagctggttgaagagtttt

SEQ ID NO: 52 - DNA, 500 bp, Homo sapiens
aaataataataataaaagaaattctagtttgatgattctttacgtgttgggaatacctcacccccatgtctccaatgacaccatgagtttacaacttctggtgtgatggaagcagaaaatgggtcaggacgcctcagtccctcagttctgcaaactgattgtgttcacaaaggctgattgacaggccccaggccatctgccagcagctcccagggagccacacagaaatgtgttggagaagcctttgagcggtggagaatcacacagccaggcagagtaacgcaggttctgtctgaacacacttggcatgcatttgacagcaagataaaggaagagtgaaatcctgtctcgaggggctcattgtttcatcgttctgtaatcattatagaatcaagtactctaaagctcagaaaggaaagacagcccttagtttacaagacctgagagcccttacccggaaaatgtactgaaaagataaacattttggaaagcagttgggc

SEQ ID NO: 53 - DNA, 500 bp, Homo sapiens
aaccatttaaaaatataaaaatcattcttagccatgggccagatatggcctgcaggctacagtttgcccatcccttccctaaataatgcagacaaatttaaaatattttttactaaacagttcttacaaatcattaacttgtaacctcctttggtattgtgaactgatactttaaagaagttcaaagtcttgtccagccttggcacaggccagtagtcccagctgctcaggagggcaacgcaggaagatcgcttcagcccagaatttggaggccagcctgtgcaacatagcatgaccctgactctattaaattttaaaaagcagcagcagcagtagctcacagtctcaataaatttgatctgtctccaagtaattgaaaattccagagagttcaaaattgcaagtactaccggtggattttctaaataagacagagcacagaattttggaactagaagaaatctaacacgttctcattccttatctgtttttgttgttgt

SEQ ID NO: 54 - DNA, 500 bp, Homo sapiens
tatgaatatacacatttttaaaagtcatcaaaagatggcaagaactaaatgagacagtctaggtatgaaaatctctgctggcctggaaccacccaaagacagattttagagtatgcagtggaatgtctggattttcaatccttcaggcaattctccgtaatggtgtttctaaaacaagcttttgaagtattgaaagcaatgagtttgatgggatcctgcctgacacatacctcctggaattcactctgccgtgtggctgattatgtccggaacccattgataattcctcatgtcaacgttgggaatgcaagcacagacaacacctaaacagaggccagcctgccttttcttggaggtgggccaaggaatggttatgggagcgtgaaagctcttctcacaattctagttcttccccagtgcatggagtaatggaagggccccagcattctatacctgtagaacattatggtaagaattgaagtatgcgacaaaagttaaac

SEQ ID NO: 55 - DNA, 500 bp, Homo sapiens
gcaactgtaactttagcactaaaagcatattaaaactattaatcctttaatcataattattcatattgctgtggtagaaacatcacacatacacacacacaaacacacacacaccagttactttctgtagaatttgaaattgctctatctagcatttccggaaggttcaagctgccaccctgcaatttatccagtagcctgctgcttgaacaagctagataaatatctaataattttgaccatgtactgcgtgttaagtccagtttaagtgttttccaaagacaaagttttcatatactttctgtaaagccctacagatagagaccattattatccccatcttataaatcagactgaaaaaggttaaatagctaatattttcatctaagtctgtctgactccaaagccaacaccccaaatcactgttaaacaagcttctcttccaagttagggctcagaaaaatttacttgctttcacaacttgccttcctaggttaagc

SEQ ID NO: 56 - DNA, 500 bp, Homo sapiens
aactcgaactcctggcctcaagtgatcctcctgccttggcctcccgaagtgctaggattacaggcgtaagccactgtgccccgcctatcaggaaaactttccaagctgttatttctctttggaatttcctctccttcatctgagttaacattcagctcaaatgccattttctttgaagccttcccatacatccacaggaaaagctcccttgactctcccagtgaagtctggatttagagtgtatttcagcgcgttacaatcatctgtcattttttgcctctcccactagactgtgagctcctcatgagcagggaccatatctcacttatcttgacagccccagcccttagaaaaacacctggcacgttacaaacatggaacaaaaagtctgttgaatgaataaatgaagtcatcccttaagtagtacttgtaattactaacgggtgacccaaactttatggttttgccctttataggctgagattctatttcatactctt

SEQ ID NO: 57 - DNA, 500 bp, Homo sapiens
ctctgggggaaagttaaaggcctttctttgattttctaagggtctgtagacctaacacttactgttagagattgcgagggctggggagggggccaagggctagaggtcattcaaggactggcaggacccttgggtgcccagcctcttacccaggaccctgaggtgccaaggcctctggggagtggctgggtgggcagtgtgcttctggggactggacacttgcactgtggccttgaatttggaggatgccgtgagcagcagccttttactggtttacctgggcatggacaatgagccactgggcagtgatcgtcacagacctgatgcccttcccccaagtttcaaggatcctgaggcctcagagttctgcataggaggagaggaggggccttgaaaagaggctgggattgaatttttctgaggtcctagtaggtgtggggtctaaggacgatttgatttagaaattcatgaaatgtgtcatttcttgccccaagctttgt

SEQ ID NO: 58 - DNA, 500 bp, Homo sapiens
ccacacagtgaatgctcacaacgtactccctgaataaaaggctgagggtgggaaatggttcctagagacaaacacaagatagtcacaagtaaaaacctgacatttagggaagaattagaaaagttgtaaaggctcaataaatctaaggccctgagaccatttacttaggaattttcccagtgcagctcataactcaacaggccctgatgtcattgtttatctgtagcacaataaaattattcatgctcacggtgaggactctgagtcaccaaaaagaagataaaatatgtttagtcactagatgtaaaaatggcaagaaatacaaaatcacatctttaaaatcatttcatctaaagtggtcaagatgaatattttggacctgaagtcttaggataatcctagaacacatacatggaaaatctcatcacccatcgatgctatctgcacaaatgaggcaaaactgcattattcttcacaaatgattactgtctgcaatctac

SEQ ID NO: 59 - DNA, 500 bp, Homo sapiens
ttcttttctctgaacattttgtaatttttgttgcctaattgtgtcccatgtttccattcccagctattgtaacaaacttgaaaattccatggtaaattgctctccggtttcccagtacttccatttatcatcgaatttcttcccagtggtcacattcacatccagaatatttcttttcctatttgagaggtggaagggttagcaaggcatttatcagagacattgattttatctgtgggagaattctagcggctatcccaaaagttgaagtccccatcacagcttatttgtgtcagcctcagtctctagaataccagcaattcttaatgcttctactttccttgcttttgccctgttctagtgcagagtcccatttcatcaaatctcagtgatgcttaatagtatcatattaacttatttgtaaattgtcagttttctttctttgtttaatacccatattctgggcatgggtttccacagacctgagaccactttgttgc

SEQ ID NO: 60 - DNA, 500 bp, Homo sapiens
atgcaggcataaagaagctaagtaatttgcccaaggtttcacaacgcgggtggtatgacctgcatccttcatttgaaagtaagaactttcagacacaagcagcttgacttcagagacttttacctaaatagtctcatttaaccttcataacaccctgtgatgtaagttctcttacattacttgcattttatagatgaaaattccaaagacaaaatagatggcagtaatttgttcaaggccacacagctgcgaagtagttgagttgggatttggatccatgtctgactacaaagcccccattctcaacaccacattagattgttcatgccccaaagtattcacagtggtacagagcacccgcatttatatgaggattattttgtaataatgattaacattcttccaacacctaggaagtgccaagctctgtactaactgatttacataataatagctaacaatcgctgtgcattattaggagccaggccctgagctaatcg

SEQ ID NO: 61 - DNA, 500 bp, Homo sapiens
gaggatggacacagggcgtctgcagaattggtgggcagatggacggagggacgggccgtgcagtgcagccggcggggccagggccaggccgagggcgcgaggtggcagccggcccggggaggcggaggctgagcgagcggtggtgtttgtggagctgtcggctgcggtggaattatgaaaaatagcaggcatcggagccggccttcagcttcgattaggggagatgggacatgacaggtgcgatcaatacgcagccgttctataaagtgtcaagtaatgaatcaatttcgactaaattttccatttttcagaggccgttctccgagagaagaatatcctcttttgtaaagatattattatcgatttcggcggcaatttgacatcaggggtagttaattccactcagaataaaattgaaaacacttgagagagaaaagagagaggcgaagagtgagacagagagggaaagagggggagggagggaggggctgggagagaga

SEQ ID NO: 62 - DNA, 500 bp, Homo sapiens
tggtatgaatatggcacagtctgattaccttttctcctgtgggtggacatttggtgtctttctagtttggggctattatggataatgattcttgtatgagtttgcttttgttttcctgatatatatgccaaggagtggaattgctgagtcatagggtaggcgtatcattaactttattagacagtgctgaacagttttctaaagtatttacatcagtttacacttccaccagtagtgtgccagaggtcccgttgttctcaatctcctgtattgatttccgtcatttctatttttctttttctttctttttttttttttttttttcagactgagtctgtttctgtcgcccagactggagtgcagtggcatgatcttggctcactgccctctgggttcaagtgattctagtgcctcagcctccgagtagctgggattacaggcgccaccaccatgcctggctgttattattattattattattattatttttgagatggagt

SEQ ID NO: 63 - DNA, 500 bp, Homo sapiens
ttcctactaaagaatgttgagtaaaatttgacattgctaaatgtggtgatctgacatcatacagagaaagagtggtgctgtaacttgccggctcagttttccagctgtgatttatgctaaccattaacacgtctgcagtttacaagtctatgtctgccaccttacacagagacccacagcctggaacgcaaagccacacacaaatgaaccgcactcttagcagaaaggtagagctgaatacaagaggcacgcagcgcttatcctggagcttgctaaccattaaccaaaggcactcttttatcccaaactgtctgaggattaaaaggggttgtagctggccaacataaactaaactccaatcatagaagaaatgtcagtaatttttctttacctttgccattttacaacctgattttaaaaatgtactttgattataggattgcctatcgaaagtggtcttccaaaaacctgtttttgaatggatcatcaggaagattggg

SEQ ID NO: 64 - DNA, 500 bp, Homo sapiens
gatagttgaccagatattgctggggttggtgctatggttctatctatgtagccaagtagcttgttcatagatctttcgaatgttagcctcagtctgtttggagctggtaagacatgtgcagcaggttttattaataactgcacaaacttcaccttgttcagctagtaaataatctaatgctaatctgttacagagaactatgtttgccaaagagtctagaaattcttgaattccctttaaggcctgacccgtgttggtggctaaggattctagggtttgagtcaagttctttacggttgactcgtggtaagcaaggccaccctagggtgccaccagtcctattgttgccctgattcccgccaaaattaatcctattgctcacttacttctgctgttcttgggtcttatggggttatagactgtgacctctggaggggcaagggtagctattgtacattcgcctctgttccaagtttttttttttttttttagacaaagtc

SEQ ID NO: 65 - DNA, 500 bp, Homo sapiens
tctgtgtggctcaggagcttctggcagagcacagagccatcagagagggggcccagagagcagagagaggctctgctgacatggccagcccagcgcctcatcccatccataaccctgctgccctgcaatgactctcttcccagcaataaaatctgggtcacaggagttggagctctagccatcacttgtctctaataaataactcccattgattttccagctcagggctcaccactccttcaccgtaagcgccaggaggcagacctggaaaatcactcacatattattggtgctcttcctcccccatcctcacccaaggtgcatataaaccctgaataacctgaagtctaagggcatgaatatcagacgctagggggacagccactgtgttgtctgctaccctcatcctggtcactgcttctgctataacagccctaggccaggaatatgaacaagccgctgctttggatctctgtcctcaccagcctcctggaagcctt

SEQ ID NO: 66 - DNA, 500 bp, Homo sapiens
gacaattaggagattaaatctgcaacaaaaagaaaaatagataatatatcaccctggagcccaaaagtagtttgttttgtttgtttgtttgtttgtttgtttgtttgtttgtttgcattaactgcagttctgggttatttattccccttattttaaagcgagtgagagttggtctctgtgatttagtttaagttgatggagtaaggaggacaatgatcatgtgtgcatcatctgctctatactaaccaccgtcttgtctaatttcattctcattatggcctctgagagaaacatgattatcttcatggagaagagaatcagaggctcagaaaggttaagtgacttgcccagggaagcacagctagtaaatggcagaggtgggatttgatttcaggactgcctgactccaaagcctatgttcagagggaccactggggggcaaacccagggcccagttgaaggggttcccatcttacggtgctctacaggcacaggctcag

SEQ ID NO: 67 - DNA, 500 bp, Homo sapiens
ggggtggtgtgccaggaagtccacccaaggctcacacagctggcaagggacagaacaggatggagacccaggtgtgtgggaccaaggcactgagccaggccccagatctccagtgagcaagacagacctagctcctgcccttgagagggagcacccaggattccggggcggggcagacaggagcaggggacggaaaaatcaataaaatcaatggcaaactcctgcgctggggagctgggatgagaagcgcggaacagcacctgctctagagaggaaagggaggcctctgaggatgatgctgtgaccatggccatacagatgagcccaaaatgcatttgaagcagaagggacagcacgtgccgagccctaaggaacccatgtttaactcacccgctgacctgcatgtccccagccgggcagtgtcttactagcaacctctcggtctgtgtgggacctaatagtccctctttaactgtgcaaggatgcaattcaacagacat

SEQ ID NO: 68 - DNA, 500 bp, Homo sapiens
cttggggaaaagaggaactgttgatatagccagagcccgaaaagaagattactctgcaacagctaaaggttggtgacatactttttctccaacttagtgaaagctctctatgtttgctttccttctcatgaattccattagtgtattttctctaaatgacccttggaacagataggaaagattttaaatcaatagaataagcttcatggagaccaagagtttatctattattgattccccagcatctagcgtagtgcctaacatgttgatgctcaataaatcattgatgaagaaagaaaagaaagacaggtggaaaggagggcagaagagaaagaaaaagggtttggagaataggtatgaatgtaaaaagtgttaatgtattattcagaaatcatgtgacgataacagtcttgttttcaaagtaattgggtatattatccctgctatctggagtcaataaagcaattgaagttactttgtaaaatgaagagtgtatttat

SEQ ID NO: 69 - DNA, 500 bp, Homo sapiens
aaggtgctgtaattgcaaaagaaaagaaattttcaggaccgtttaaatgtattttgccaagggggaagttaaaccctggaaactgagtcatgtagcatgtttgcaacttacgcttcttagattatagattaactctcttctgcattgttcttgttctgtaaatgattagaagagaccagagaccagaattccttcccttccaatcactgatctttgttgtagattaagcccttccatttttgtcttgtacgtaactcagaccagatggtacaaaagagtccatgactgttacatcttcagtgtggaatgttaaatgtacctttcctgaaaggaaaagaccacctcgactaatcagatcattgtaactctgcattcggcctcttgtagaaaaatgttgaaattctgctaagcttccctaaaccttgtctatgtaaacaatcccaaacttctacacttcagaacactgacttccattctttggaatctgtgcttcccaagtg

SEQ ID NO: 70 - DNA, 500 bp, Homo sapiens
ggcggccacagtcatggaagtcccaacgcttctctcggctccgcaaccccagagggcggccacgaggagggcccgccacgcacgaccccagagggcggccaccaggagggcccgccacgcgcgaccccagagggcggccaccaggagggcccgccacggcgttgcggcagcagcccagaaggtgccctgcgcacggtccggacaggtgggatccgagttacctggccaagggggctgacgcagacacgtcgcgggacacagtgaagagtgtggtgcagagcggagggcgggagtctttggagaacaggtaggggcgtggggcacgcgcctcccacgcgcaggagccgtctaccgtggagggacacgggtggtcctgctggaggctcctctccgttagctgtctccatcgtctgattcttggatcccaggatggtgggatcatcagcaactgagatgaacccactgccccggccccctgagcccgcaggtccccacgcctt

SEQ ID NO: 71 - DNA, 500 bp, Homo sapiens
ggatatatttaagggttttacagtgtgatatcatattcacagtagcatcaattagtggtaagatttatttcaggagtttaaatcaatactgcagggcttttctgcagtactgcttaaaatactcgaatgccaattttattgcctctgggatcacactgacattttctcattagtattgtgcccattccccccctagttaagcataaactctgtttgtttccgtcctgtacaattagtgcctatattattcgacaaacacacatggttcacccattctgtgccagccactatgctgaggggttccagaggtaataggacaatcagaggagtagccagataaccactttgatatgaaacaaaactacctaatgctttgaaagcacagggagagtggccacctccacaccaaaaaactggggaaagctgcctgttgaaggatgtgcaaaaattagcagagaagaatgcaaagcatttaccaaggaaggagagcagcatatgca

SEQ ID NO: 72 - DNA, 500 bp, Homo sapiens
ctacgtatactgccaatgggagtctaaattggtaccttgatgcaatcaacccagagagcaatttggtaatagctaacaaagttgcagatttcgcagcaaattcacttttgggaatctgcttggtgaatccattgcacatgatgttcattgctgctctgtaaggccgttaaagtagaaataacctctctcactaaggaatgtaaaaacaaatatgggtcagtcatacaatgagcagtgaaaattatctagcgattgaccaaatggataaatcttgagagtataattttgagagaggagaaaggtgcacaatgagaggtacaactatgattccattccatgatatgtctaaacatgcaaaagaaaatattatttatgggtatgcatataaggacatgcatggacatgatatacaacattctcagcacagtgattgccactggggagggagacagaatgagatggaggaggtacgcaggggcttctgcctatatgtattgttc

SEQ ID NO: 73 - DNA, 500 bp, Homo sapiens
aaataattggcagataaaggctggttaggagagctccttggtgtagatttcctccagtatcacctccaggcccaaacggtccaatgctgtctttagtagttaacctttgttctccctggtagaagaggaggccaggatatcttttgtctctggaaatctatgtcctgcttttaggcaaatagagggagggcagagagctttctccatctccttcttaattgtcttcagctcgacaatccttcatatttacgggaagcatattctggtctcctacatgtgcatgtgtaaataaatgacacttggcaaatattagccagtcctgaatttaggtgagggtgggtgcatggataggtatgtattctaccacatgtttaaatatcttcataagaagttagaaaaagaagacattgagggaaagctcagaggaacatgtacccacatgtgccagaaaggaagccggcaagctaccctggccacaccagggtgaacagaataaactt

SEQ ID NO: 74 - DNA, 500 bp, Homo sapiens
ccaagctgaccttggaccaactctcaaggactgggagctcatccagccatcccggcctccccggggaaaggggaggggggcgctgtctcagggtcacatgcctactaagctccctcctgacccccgacacggggaagtggggaggggtctgcgggttgcccagatcaatgattaacacagaggccgtgggcagcatatcacagggcaccgccgcagcacgtgctacgcacagatgcagcctgcggacggcggggctggggtagctgaatgtcccctggactctggtccctccagggccccaggtgtggaaaccgcggcctggcacagggaaagcgtgggctgtgtggccagacggggctgccgtgtcactgtcccccctgagactccgcctgccgggaacctaggaatgtcccgctgacactagagccgctgggaagacacactagagaagcttcctctgaacagccggggaaacggtctgtcctcaacaccaaacaccc

SEQ ID NO: 75 - DNA, 500 bp, Homo sapiens
gaaaggcaggatgcgacgacctcccgggtcccaacttgcttggtagctagctttgtgtcttgagccttatgagaatgtaagccacctggtccatatggcctaccctagtcgttttacaggtgggaaactgaggcccagggaggttagccggcctggaaaaacattattattctttgttcctgtttctctctgccttcttccgtgcaggatttcagacagcttttagaaagaatgcatacattataacaacggaaaaatacaaacaatggtaaagaatccttgccaagcaaaatataattatgaatagacagtcaaggccaggaaaaaagagaacagaaatccgtgatccataggtgaggtgacttggctaaggtccctcagaaaagtcgtgccaaagctgggactagaagtcagaacgtccggcttctgaacgccagaaacttacagtggggaagcagacagcctgcccaggcactggttcttaaccttctgggggtccc

SEQ ID NO: 76 - DNA, 500 bp, Homo sapiens
ctgccccagggtcactgtgagatcatgtagtctgaaccgcactaagcactttgcagagtgttttgctcttcctttagccccagcttgttttccagggtggagagtggaggtgaggaaggaagcccaggaccagggctgtggaggaggggagactcagcgggttgccaccatttgtttactcacctgagtctctctgcctctagcctagctgtgctccccgctaaggtaaagaggtggggtagccttgctcggccaatgagctgccgtcgctctcttaaaggcacccagcgtctggaaggaaaactagcctggcaacctggagagctcccgggccagagccaggaggcagctgtgcgatctggatgtacctaaaccctccagggccacatagtgaccccaggccctggtcactccatgctttggagggtgcttttgtcaaagaggcctcctttccctcacccagagctggatttccaagaggctcccatacctagctgccc

SEQ ID NO: 77 - DNA, 500 bp, Homo sapiens
gagctgagtccttagggctcctggcagttgccatccaggaagcccctgctacgttccaagcttagaatctccccacactatctccttggatgctcacataacagctctgcagagccactcttcaaacctgctcttcatgatggggaaactgaggcactgtgatttgccaaagagccgtagccagtaaggatcaaggcagcattcacgcctgggttctctgactgtaaatctggctgtgtttttttctttcgaattttattatgaatgccttctttgttcattgtcattattatcatcatcattgatctctaccaggccccctacccccagccacttgcctcctctgttgcaagaggagatgaggagacaaatgtggaatttttattcccattcccttccctcctccataggcagccactccagtgtgcttgctgcaggccctgcatgagggcctgcatgaggatcctccctgtcttgttctgattgggtatctgttttta

SEQ ID NO: 78 - DNA, 500 bp, Homo sapiens
catagtaatagtatacctaatcaatacataaatgttataaacactccacaacaaacaaagtaacatttaatatcaagagaaaaagggagataggaggaaacgttaatgaaccagtccggtggggagtgaagcagacaccgggagccctgggctgggcggggtggtccgtggtcttacgaggaggactcaggtggcagagcctgcggggcagatgccaagttcttatcacaagtgactgcgaggcggcagcggctgaggcagagtcctcccatgagaactgagtgctttttgtgtccttacctggttggatactgtcctattttttttaatttgtttattaagcaaatcaccttatctttgttggcaaagtgccctatgaaatgtaaaacaaagtctttttctaagacggagtttattatgtcaacagtgctctatatactatatataaaaactaaactttaaaaatgttgctgacacgaaaattgagagaagcctacgtt

SEQ ID NO: 79 - DNA, 500 bp, Homo sapiens
ttggaaagtcgttctttccattgtgatattctctagctagaacccagagaggataagaaactgcctcatggtagcctcccaggggagaaggttctagtaggagatggcctcagagcaaggacttccagcctcccatcctctggtggtctgggaggatcacaggatgtcaaggccttgctcctgtggccttgattcagattagctgtggttcaagactgcctgtgtggcacatgtggatacgtgcaaggtcgctgaggcagtgctgtgcccttaaagtttatctgcttttccaacccaaaagcagactccctaaagggtagggaatgcctcattactcactgggccctcctgcagctcctggcatggaactgacacatagttggcactggcaatgcacatacttactagatgttaaagaagtccagaaccagaaccagaggcacataaataggatctgcatcagcagtgggttagagaaagggtgggaaactaagtgaaat

SEQ ID NO: 80 - DNA, 500 bp, Homo sapiens
tgtttttcaaaaaccgagaccctcaccaaacagatctaccaacacagaccacaaatgcaggggggatcacaggcccgaaccctgaacccggctctattctgaatttcttcctcaggggccaggaggggtcatgcctgtgggccagagccaacattcttttctgctgatctcaattgtttggacaaagcttctcctccttaaccaatcacaaatcaaaaacgctctatatccgacccatgggccacacgtcgtgatgtctgccttctcaggtcaaactgacatacggcctccatgtactgatttatgactttgccacaacctcagcctccccaccttctgaaacccttgcctgtgaaccctcggggtgcctgggtcgtgggcgcagcctgccctgccagggtgcacaccccgaagcccctggtcagggagtggaacataaagcccttcagccctcacttgacaccgcgtcggtgcagccccacggcacccccacacttgat

SEQ ID NO: 81 - DNA, 500 bp, Homo sapiens
tttaatattcatagcagagtgaatgcagtttcattttgacatgggataaagaaagagagagggtgatttagtgatcttaaatgctggtgttttgggccaagtgagacaaagggtgtgattaacaaagggactccctgtgggtgtcagagtgagaggccaagcttgcctgactgtacagagaagagatacaagagtggggtgtcagtgtctgggaggcttcaccagccttagggctaccaggggattaagcgcagctccaaggttgagagtgagtgtttacttcctgcattctttcactgtccttgctctagcccacaggtattaactctgaaaggcatagacaaaggcaggtgggggttattaacatttgtgagtccttactatgctccaagcccagggttaaggaccttacagaaggagcctcatttaatcacaataagaactgtgaagcaagtacaatgactgtgagtttcatagtacaataagactcagatgaggag

SEQ ID NO: 82 - DNA, 500 bp, Homo sapiens
cctgtaacatgattttggtggtttgagttgggggtaagagagaggctttcaaaaatgtatttgagagatcagtctaaaagttattttactgtaattctgaaaagtagacataaatagattcataccaaaataaaggaggcataactggaaagtatctaactttgcctggggactttgaagaaggcttcctagattagttggtgacatttgagctagctaatgaaaaatgagatgaaattccttagatgtcgaagagggttctagcttgagaaaacagtatgtgtatgctgagtaaaagaagttagggactgataatcaagtaattccatgtgccctacatatatatatatgtatgtgggcataagggttatacgtgtgtggtggtggggttatggtgttgagggcacgatgaggaataaaactggaagtagctgaggaaagatataaatgagtttttaaaaacatactctaaaggtctagccaaataaatttaccattaa

SEQ ID NO: 83 - DNA, 500 bp, Homo sapiens
acacacaaaaaaaccattgaaatgtacactttgtggaatgtgaactgtatcttgataaagcagttagaagaccttcgaacataagcatgcggcctcatggggcctttgcctgggcaccctggcacctctcccaggctctacctatctccgacttcattcctgagctcttgaacaggggtaaggcaaactttttctgcaaaggaacacgtggtaagtattttcggccttgacggtcacatgtctctgccacgagtcgtctgccttggggcgcaaatgcaggcttgggcagggaagaaataacaaaacttgcttcctggtcactgaaacatgaagtccaggtcacactcactgttacaaaatactccgaattttcagactgtggttcaatacacatgacataaaatggaccttcttaaccatttgtaagtgcacggttccgtggaattcagtatattcatgtggctgtgcaatcatcaccaccatccatctccaaaagtttc

SEQ ID NO: 84 - DNA, 500 bp, Homo sapiens
aataaatggcaagcagcacattaaagatgggcaagaggcccaggcagatgcttcacagacgagaagctcccgaaggccaatgagcacaggagagaggctgtccttagtcgccacggaaacacaaggaaaacccaacgcgggccccctccatccccccggacagccagggagagggacagcagcgaggcctggcaaggacaccgggcaccttgacccacatgctaggggttagggggtgccgtgcacggccgcttgggaaactcaggcagcatcttagttaaacatacacttgctgtgccacccggcaattccattcctagctatttacacaaaaggaatgaaacagacgtctacccaagaatgtgctttgctgccttacaacagtcaaatactggaaataacccaaacgtccatcaagaggataatgaataaagaaattatgttatatccatacgatggaataccactaggggacttcttttaaaggaacaaactcccga

SEQ ID NO: 85 - DNA, 500 bp, Homo sapiens
ataaaatgagcccaggtcttccaagtattcttcctatgacatggtacctatcctgtcattttcctgtatcatcgttaaagtatcatcacagcaggcttgtctcctcccctttctgtccaggctggcgcccaagaattcgttagctgtggggcgaggaggcggctgaatgagttaacaaactgcccttccagtcgctttggattttgcctggactccagctccgtggggtgctagttaatgtttagtgagcggctctcttcactcccacccgcaaagcagggctgtgtcgtgctgccatctccgcggcgtaaatactcccgccgtggctgatttcaaggtacccaagggaggtcgctggccggggttggggagagcctctgactgtcacagagcctgctccagccccacccgtccccatagacaacagcctcccgtgttccctgagaaacagcacctggcagaacccatgcgtctgccccatgcccaccctgagcttccct

SEQ ID NO: 86 - DNA, 500 bp, Homo sapiens
aaatctggggcatgaaaactagttttttctcttactcagtatgtgatttgcatcaggctgtagtaggtatttgtgtcagttaagtctggaatatttggatattggatttctgggctggacagtgatggatgaactgtttactgctgtaggttgaagaattttctactgaaagaaaattgaattgttttttgctactggcaggcctagtgttctgttaatggaaggatgcagaccggagctgttcctattcggccatcttgccagcctagattgaaagattaaagattgctagattgaaataggcttaaaagtagatgtccaactgaatttattaaaagatgagagatggcacagtagcccgcgcacttgaaatctcaagaaaatattgcatagcatttaaaaaatatttgctgaacattttatttaaacatggaaaggtattttgctgccacactgatagttcagtgaattgcacttttggatcttggagaatggagaga

SEQ ID NO: 87 - DNA, 500 bp, Homo sapiens
gagaccctgccgtctaccccctgacgcttcaggactctatggaggaagactttgatctcattattggaacaacctagatggaatctcatcggtcctcaataaccctgttttccctttcccactccgtttacttttcctctaaaagttcacttggaggaagggaagggtggcgagggtggtgggagcggcgggcggcggggagtgacaggcgcttggtccggcgcggctttgcctggttgtaacaagcgtcgggacatgcggagccacagaagccgggctggccacatcatcaatcacggcgctgacagccgccttcagtttgtttgttccactttgcataataagtgatcggatcaggtttaattagatattgggtaatcaatcattgccaacgaggcaactcagcttgggatctagatgctgcaaggggaaaaggcaaaaaaataaaaacataaaaaaaccagcaaatctcatcttgtgtgcataaatactccagccca

SEQ ID NO: 88 - DNA, 500 bp, Homo sapiens
caagacaaacaatagagttgagaaggaggttaacacaagcatgtgtttcatggagtctgactcacaccgagaacaggaatgtggctctggcagccaatgcactgaacaaggacctgaacagtcatacagctcaaggttcaagcaaggtagaagcaaaccagctgctctgaagatgctcacctacttctgaccttgaatcttccacttcatgaccttcatccaggagtagccactgacatctgtatggtacgttactgttttcacagtattctgtcttttgattctcacatcagttctatgaggtaagtattttattgttagcctttctttagaaatgagaatattgaggcttagaaaggtaatttcttgccaaaggccacacagctcctagtagaagaactggaattcaaagccaggttcatttttggcttccaccgtgactgccaactgcttgatgccagaatccaaatggctgagcttcacactttatgttggaattt

SEQ ID NO: 89 - DNA, 500 bp, Homo sapiens
ggtgcttgccctcagccgtttctctcttcttactttgagaataatctcttttttttctagtttctcttttcttaggcatactcctttggaaacttactgggctcacttttacccactatgagaccctatctgtcatgagtagtgcaaggttagagataaccaggtccacatgcacttgtgtctttctgtagtgtgaggcctttgttgacgttatttcagtcacaaaagccgggaactgctggtgcttcccgtcactcgggtagtcccagccgcgggcacacaggctcaagccactcctcacatcagtcaatgttgtaaaccatagtaatagtatacctaatcaatacataaatgttataaacactccacaacaaacaaagtaacatttaatatcaagagaaaaagggagataggaggaaacgttaatgaaccagtccggtggggagtgaagcagacaccgggagccctgggctgggcggggtggtccgtggtcttacgag

SEQ ID NO: 90 - DNA, 500 bp, Homo sapiens
tgggaggtggagactacaatgagccatgattgtgccactgtactcagcctgggtgactgggtgacaatgcaggaccttgtttcaaaatttaaaaaggatgagcccttcagccttcagcctaaaagtctgctcaccactatcactctacattgtgaattaacccttcacgtgcagccctccctcttctcatccccagctagacggcttattggtgtatcctcaactgtccagctaataggcttgttgatacgttgattcactgatgaatgaccctttgaataacttggcagcatcatctcatatttgtacattgtacagttcacaaaacaggttcatagctatcctttgcttcaaaactgccaacacagagcctcaaggattatgtggtggaagaatcactatcctcacttcacagaggtgatcctaggtctcggggagatgaggaggcttgaggtcttgtgactgggtgctggcagattggaacttggacccaggccttt

SEQ ID NO: 91 - DNA, 500 bp, Homo sapiens
cttagcttaaaagctactgttttaagaattgtccagtagtaaagaagagagcaactgttatttgacatcagatatggtggtataacaggaattttaaaagaaactttgacatcccatacacacaagcaaggaatcatgcttgtattttcaaataaatgctactaactcatgttttacagatttcaaagcactcttacacactgttcacagcaagggaggccaagcagctattttaataattacctaccacgggtcaagcactgattgtgtagtatggggctctttgctggcaacttaatatccatgatctcatttcatcctcacaacaatcatgccaagtaactattatctccctcttaaacaaacacggaacctgtggctcggaaggtttacataacctgcccaaagacacatggctgacaagtggtggagccaaagttagtccccgtgtcagtctgtgaaaactccttttatcgggctgcacagcttcaatgtcaccg

SEQ ID NO: 92 - DNA, 500 bp, Homo sapiens
tgctgagtccggcatgcagtagggctcaggtggccagctggccagcccgcctgtctttcctgctctattcgtggaatcttaggaaaattacttatatcagtggctcttaaacatggctgcacattagaattgcctgaaaaggtgttttattttgttctttaatatctggatgaccaggaaataccccagaccaattaaataaaaaactctagagggtcggctccagcgtcaaacctccccaggtgactccgctatgcagtcagggtcaacagccactgttttaaacaatctgagctttgtttccagggtttttctaaatattaaatgcaatgtttgcaaaagcttggcccagttcctggtgcatagtgagtgtgcagtaactgttaattgttgtattatattttaccctggtttttcagtccattgctaataatgtcttgcacagagtaggtactgaataaacactggttgaatgaacaaatgctacttagggagaccta

SEQ ID NO: 93 - DNA, 500 bp, Homo sapiens
caaacaaggaaatgagtctttgatctcttgagaattagacaaaaatggaactttcaaggatagagaaggctttagaaccttaaaagtttcattttatttttattttgaaatcctttggcacttacagaaaagttccaagaatagtgaggcttcactccacctcccctaatgttaacaacttacataaccacaatacaatgatcaaaaccaggaaattaacatcggtgtgcgctattaactaaaacataccggtttcaccagtcccttcctcctgcaccccgtctcctttttctgttttaggatccaatccaggatgctacattgcatgtagttgttctgtcttcttatctgctacaatctgtgatggttcctgagtcattcctcgttcttcagcaccttgtaacttgtgatgaatattggtcagctatgttgcagaaagtctcccagtttggatttgtctgatgttttctcattatttgatttaggttacatgtttctgg

SEQ ID NO: 94 - DNA, 500 bp, Homo sapiens
tttgctgtcgggaagtgaactgcatagcacaatgaccagtcaccagctttgaaaggcttgcttagtcactgggcatgatgcatctctgtttacatagtagactgaagagctgccagtgaagtttgttctctgcagttactcacagttcgtattcccatagtagttaataactgaaatttgaaccatcctgtcgggggactgataatgtttaactaagccatagtaactgaaattcatgcagctcggaaccgtgcaaagcaaggaacacacacacacacacacactctctctctctttctctcactcattgttaggcttcttcttgtgtattttattttattccattgctgttataaatagttttttccttcttgctagcattttgctagcattttaatattgtttccatataagaaagttgttgatctggacggaatgttagttttgtggctttattgagttattatttgtaacagtttttaattttctattggattgtt

SEQ ID NO: 95 - DNA, 500 bp, Homo sapiens
aagcaggtggattgtgaagagggtcaaaactgggagaggggcccctcctggggagtgggttttcaatgttttccccttttttcctcccagctctgccctgacgtcaggcctcaggtgcagagctgcactgcgtggtagcacaagccctgagttaacaagagaaataccggctttctggccagaggaatgaagaaaaagggcccctgcgggcaggaatgtgtaggggaatctccaaactgagagtacaggcggaaattccctaattctgagtctgaaccctcaggagtaccaggttacccctgagctgcacatgcgtgtgacatgccttaagggcacagcaaagactttgagaactgaatgaagattagatcttttaaaattggaagacttcggccaggcgcggtggctcgtgcctgtaattccagaactttgggaggccaaggcgggtggttcacctgaggtcaggagttcgtgaccagtctggccaacatggtgaaacc

SEQ ID NO: 96 - DNA, 500 bp, Homo sapiens
gaattaaagtgtccaaaattacatcgccacagaggttagatttacttcccctttcactcccacccccaccccgcaaaaagaagagggaaattcaattcatttctgcatttgagggaatctggcctttggaggagtttggtgtgtagttgccattacaaaagggaaagtgtcaggatggttttcatgtgtatttgtttttttaaacaaagaatgatattgttgacagaaatgtcacatttgttcattcagcgaacaccctgagtgcctaccaagtgccagatacttattgttgctcctgacagtggccaacacacctggatgtgttatcttggaattatgaacagattctgggtaacacaaagaaggggctggaagagttgagaaaatttcagagaagggaacatttgagttagggatagtaagtttttattaaatgaccacctaggctgtgtcacaaaagccagctggacatgccatctgctgccggggtagtggggggt

SEQ ID NO: 97 - DNA, 500 bp, Homo sapiens
gctgctgcctgaagaagccttccatctaatgagggaggaagagaatagccaagcaagcaaacaattttagatggcgataccttccaaggaaacaagcagggtacagcagcaataggataaggaggcagaggagcatatatttacacaggtggtttgggaaggcctctctgagtaggtgacttttaaatggaaatctaaaggctgaaaaagaggcagccctgataagagtcagaagacaattctactgagcgaatagttgtttaaaaaacaatctgtaactagtccagtttcacatctggggtattgaataagagcttttggataatgtcttccaatccttaccttcctattgtttccaagttgaaaagggctccatttctgtagccaaagccccacatttttttgtttgtttattttttaaagacagagtctcactctgtcaccaggctgtagtgcagtcgtgtgatcttggcttactgcaacctctgcctcccaggctc

SEQ ID NO: 98 - DNA, 500 bp, Homo sapiens
ggaggtggcttcctgccccattgttctggactgcagtgtttcttgggaatacttactgtatgtggattttcagtaaccaacttggaaagctgtatttgttcccatgattcagcaaacaatgagtacctactgtgtgtagaagcagcaggacagcctgtcatcactgggaaagaggccagaagagccgtttggccagggtctccaatttaggctttcaacattatctctaaagaaggttatacattatgtcggctccactggctgatgggatcaaagaccctccttgtatatccttaaacctgtactctattaccaggccactgtgcctgtggagcactgtaagttcctaccttttaataaattttataattatcttgtgagcagcacaattgtcatagttttttgtatcagaaacattaatttgttaaacattttaaaacatgccttgatgtgtgtaatcctgttttgtcatctcttcattttcaaacagatggggcacc

SEQ ID NO: 99 - DNA, 500 bp, Homo sapiens
ggagaagctgggaagggagaccaggtggggctggcccatgaaatgaagtggcaggcttcaggcttggctccaagagcaccagtatagcaccactatagctgctcttaacctcgaatgcacctggggaggttcaaaaattactcatgccagagattcaactctagaagttctaacttcatttgtctggggtgcagcctgtgtactgggcttttaagcttcccaggtgatttttaacgtttccaggcatgccgccaaagttaagaattgctcttctattggccaataacaaagtctacctttgttatgccaaagtgagcctggggctgccctcaactctgccctcactgcacagatctgagctatgggggaagctagtcatggccaggtctacccagacagggggttttcctagcttagccaaagtatcctgacaatccagggctcaaatagccagggcaagtacacaggtgatgaataaaagagagaagcactcagtgggt

SEQ ID NO: 100 - DNA, 500 bp, Homo sapiens
gatctaatccaatccctttagtcccgtctctttagtctcccttcatctggagcaattcctcagccttctttgtccttcctaactttgacatttttgtagtgttataaagccactagttttgttgaatgcccctggattttggtttgctgatatttcctcatgactggactcaggttatgcgtttttggccagaattccacatgatcaggaggcacatgatgtcggcgtgcccagcaggggtgacggtgacgcccatggcctggccgaggtggtagccttttgctgctgtaaagcgactcgtgttccctttgtaattaataagtaatctatgggagatatttttgagactgtgcctgtgtatcgtgtttcccaacgtgttttcacctgatggtttgattgtttattgagcattgactcctgaccaaactcctcctgaagttcagctgcaggtcaacatcttgacgggcattgaggtaaacaccagcgttcattgttttttg

SEQ ID NO: 101 - DNA, 500 bp, Homo sapiens; identical to SEQ ID NO: 51

SEQ ID NO: 102 - DNA, 500 bp, Homo sapiens; identical to SEQ ID NO: 52

SEQ ID NO: 103 - DNA, 500 bp, Homo sapiens; identical to SEQ ID NO: 53

SEQ ID NO: 104 - DNA, 500 bp, Homo sapiens; identical to SEQ ID NO: 54

SEQ ID NO: 105 - DNA, 500 bp, Homo sapiens; identical to SEQ ID NO: 55

SEQ ID NO: 106 - DNA, 500 bp, Homo sapiens; identical to SEQ ID NO: 56

SEQ ID NO: 107 - DNA, 500 bp, Homo sapiens; identical to SEQ ID NO: 57

SEQ ID NO: 108 - DNA, 500 bp, Homo sapiens; identical to SEQ ID NO: 58

SEQ ID NO: 109 - DNA, 500 bp, Homo sapiens; identical to SEQ ID NO: 59

SEQ ID NO: 110 - DNA, 500 bp, Homo sapiens; identical to SEQ ID NO: 60

SEQ ID NO: 111 - DNA, 500 bp, Homo sapiens; identical to SEQ ID NO: 61

SEQ ID NO: 112 - DNA, 500 bp, Homo sapiens; identical to SEQ ID NO: 62

SEQ ID NO: 113 - DNA, 500 bp, Homo sapiens; identical to SEQ ID NO: 63

SEQ ID NO: 114 - DNA, 500 bp, Homo sapiens; identical to SEQ ID NO: 64

SEQ ID NO: 115 - DNA, 500 bp, Homo sapiens; identical to SEQ ID NO: 65

SEQ ID NO: 116 - DNA, 500 bp, Homo sapiens; identical to SEQ ID NO: 66

SEQ ID NO: 117 - DNA, 500 bp, Homo sapiens; identical to SEQ ID NO: 67

SEQ ID NO: 118 - DNA, 500 bp, Homo sapiens; identical to SEQ ID NO: 68

SEQ ID NO: 119 - DNA, 500 bp, Homo sapiens; identical to SEQ ID NO: 69

SEQ ID NO: 120 - DNA, 500 bp, Homo sapiens; identical to SEQ ID NO: 70

SEQ ID NO: 121 - DNA, 500 bp, Homo sapiens; identical to SEQ ID NO: 71

SEQ ID NO: 122 - DNA, 500 bp, Homo sapiens; identical to SEQ ID NO: 72

SEQ ID NO: 123 - DNA, 500 bp, Homo sapiens; identical to SEQ ID NO: 73

SEQ ID NO: 124 - DNA, 500 bp, Homo sapiens; identical to SEQ ID NO: 74

SEQ ID NO: 125 - DNA, 500 bp, Homo sapiens; identical to SEQ ID NO: 75

SEQ ID NO: 126 - DNA, 500 bp, Homo sapiens; identical to SEQ ID NO: 76

SEQ ID NO: 127 - DNA, 500 bp, Homo sapiens; identical to SEQ ID NO: 77

SEQ ID NO: 128 - DNA, 500 bp, Homo sapiens; identical to SEQ ID NO: 78

SEQ ID NO: 129 - DNA, 500 bp, Homo sapiens; identical to SEQ ID NO: 79

SEQ ID NO: 130 - DNA, 500 bp, Homo sapiens; identical to SEQ ID NO: 80

SEQ ID NO: 131 - DNA, 500 bp, Homo sapiens; identical to SEQ ID NO: 81

SEQ ID NO: 132 - DNA, 500 bp, Homo sapiens; identical to SEQ ID NO: 82

SEQ ID NO: 133 - DNA, 500 bp, Homo sapiens; identical to SEQ ID NO: 83

SEQ ID NO: 134 - DNA, 500 bp, Homo sapiens; identical to SEQ ID NO: 84

SEQ ID NO: 135 - DNA, 500 bp, Homo sapiens; identical to SEQ ID NO: 85

SEQ ID NO: 136 - DNA, 500 bp, Homo sapiens; identical to SEQ ID NO: 86

SEQ ID NO: 137 - DNA, 500 bp, Homo sapiens; identical to SEQ ID NO: 87

SEQ ID NO: 138 - DNA, 500 bp, Homo sapiens; identical to SEQ ID NO: 88

SEQ ID NO: 139 - DNA, 500 bp, Homo sapiens; identical to SEQ ID NO: 89

SEQ ID NO: 140 - DNA, 500 bp, Homo sapiens; identical to SEQ ID NO: 90

SEQ ID NO: 141 - DNA, 500 bp, Homo sapiens; identical to SEQ ID NO: 91

SEQ ID NO: 142 - DNA, 500 bp, Homo sapiens; identical to SEQ ID NO: 92

SEQ ID NO: 143 - DNA, 500 bp, Homo sapiens; identical to SEQ ID NO: 93

SEQ ID NO: 144 - DNA, 500 bp, Homo sapiens; identical to SEQ ID NO: 94

SEQ ID NO: 145 - DNA, 500 bp, Homo sapiens; identical to SEQ ID NO: 95

SEQ ID NO: 146 - DNA, 500 bp, Homo sapiens; identical to SEQ ID NO: 96

SEQ ID NO: 147 - DNA, 500 bp, Homo sapiens; identical to SEQ ID NO: 97

SEQ ID NO: 148 - DNA, 500 bp, Homo sapiens; identical to SEQ ID NO: 98

SEQ ID NO: 149 - DNA, 500 bp, Homo sapiens; identical to SEQ ID NO: 99

SEQ ID NO: 150 - DNA, 500 bp, Homo sapiens; identical to SEQ ID NO: 100

SEQ ID NO: 151 - DNA, 500 bp, Homo sapiens
tcgtggctccagtgtctgccaggaggcttctgaactcgacagcaagtggggaatggattagtaacttgtttgctgccccacccacatgggggcaggttctgggaaattgggatctacaagccaaaaaccacagtgacctcagataagcaaatgacgaacgtcccatggaccttggctgggggcaggaatgtataccaaagaaaggtaggctcagtttggagtgggggtacatgccccttctgaaaagtgcgaaaccttcaccaggacccttcacaccaggcattccaccaagctccacagggctgggagggaattgacagtgaagatgtcagtctgctctccctaagtccagcccggggagaaacagcgggggatggtggggaagactagggctacagggctaccctagcggcttcccggaagaagggggcttggccaccaggtaagtgtgtctggctgatgggagggcccaaaggcatggagtgactctgggaggtgtc

SEQ ID NO: 152 - DNA, 500 bp, Homo sapiens
ccctcagctggccctgagggtttggagacaggtcgagggtcatgcctgtctgtccaggagacagtcacaggcccccgaaagctctgccccacttggtgtgtgggagaagaggccggcaggtgaccgaagcatctctgttctgataaccgggacccgccctgtctctgccaaccccagcagggacggcaccctctgggcagctccacatggcacgtttggatttcaggttcgatccgaccgggacaagttcgtcatcttcctcgatgtgaagcacttctccccggaggacctcaccgtgaaggtgcaggacgactttgtggagatccacggaaagcacaacgagcgccaggtgagcccaggcactgagaggtgggagaggggggcgagttgggcgcgaggacaagggggtcacggcgggcacgaccgggcctgcacacctgcaccatgccttcaaccctgggagagggacgctctccaggggaccccgaatcaggcctggc

SEQ ID NO: 153 - DNA, 500 bp, Homo sapiens
ataagattggcatgcgcagggcggctgggaacgcgccaccctgggtgtctataggctcatctggccctgctgataggccctgcccaggacgggcgttcacagagcaaagtgtgttttagagttattgtcaaaaagaaggctctttgtactgcttttccctggcacctttgaaactctccaatccagagattgtacctctgggttcaaagctcttcccccattttctcttctgaagacaggccctctgtccgcacagttccagtctccagtgaatcctaatgacgactgtcaggagactgcttatgtagagctgacataagttaaaatagggtccactgtgcaaacttaatccagcacagttctattaagcactctcttttaggtaggtactaccctttctagtctaaacatccttcttctcctcccaacccttgatataattatattttcttgcaaatattttgtatttatacttctggattcattatttaagaaactaa

SEQ ID NO: 154 - DNA, 500 bp, Homo sapiens
tttgataaagtggagcaagtgacgaatacactgaactgtaaggtctttggagatgggccacgtctacttatattcaatccacagggctacacctagttcttggtacacagtacatgctcagcaagagtctgttgaatgaacacatacatggtttatctgtttgtctcttccgagttcttgacttctgtctgctctgacctctggcagctttccactagtttctagctttcattctgcttacctggatttcggaactctagcctgccccactcttagataaacgcatgccctctgtggccctggaaccttagtgacttctgctataccaaagtctccacgcccagggtgacacgcagctgcagctccgtaaacctctaacatgatgtcagcaaatattaaaaaaaaaaagtttataaaacaatgaataaactttgttaaaggtacaaatgaaaattagcaaacatgggaagataattgagtgaagagtttaaagttaaaaa

SEQ ID NO: 155 - DNA, 500 bp, Homo sapiens
cctagccttttttcctcctgtggctccacagcacatgcattccttgaatatagcacgtatcacatttgactttgtttacgtggtttttcccaaaggattgtgttgagaccttgaggatgataactgtcctatctgtgttaatcaggtagtaggtgttcagcaaatattcagtgaatcgatttcaaggtcaccgctcttctcgtgctccctcaggggcacgtggggcctgagtgccagggttatgaagggcgttctttgtaggtcccgtagctgagactgacaaacgtggtacccccttaggtggtgcagcgaatgcatcacctgaggaaggggaatggacgaagatagaagatgaggtcagaggctggagccgctgtccaggacagcctgacgagccacatgcactggacggcacctgagacatggctcctccagactagagtgtgctggatttgcctgagacacactcaatttcaaagacttaacaacaacaacaaaga

SEQ ID NO: 156 - DNA, 500 bp, Homo sapiens
aaataaatacaatggatctctacacatgcacaataaagacacggaaacagttaatcccctgctgcagctcctgttgaagggaataaaatcaggacccagagaggttgattcactgaccttgggacacacaggaccctttctacctctgctggtgacccagtgacccctgtcgatggtgggaaggggcagagcaggcctcagactgtccgcaggatgatgcattcactaacgggttctaggagacggggacggctcctcttttctctctccaaaattagaacgcggggccctgaatggtatccccaactcgggcctgttcgggactgtaaatggctttctcgcttggtccccccttttgagagggtcggacaaccctgaacgaacccggcagggtgcctgcatctaggctggggctgccctcactgcagccctggggtggggggttcctccgcctccaggggcgcccgcagcgtccttacctggctcctcccgcgtcctga

SEQ ID NO: 157 - DNA, 500 bp, Homo sapiens
cgggggaaaccggaagctccattaaatacctgatgagcagaagtgcagaaaacctgtgctccgtggaactgggtatgtgataaatacataagcaataccagaatcgggttccctctccatcctgctgggcactagagcggcttttgtttccattccctctatcagtgagaagcggctcttgcttcacttgttaaaatgaaaccagagtgtggaagcccagcaatcgctggaaccctttgaccccctctccgcacctgaagaccggctgtgcccactgcccctgcggacgctccccagtgttcgcccttggagatttccaagtccagatctaaagcacccataatcagttaagacccagggctccctctagtcttatccaaaattagccctatccgtttgaaaggcttgttcaaatagaaaaggacaaaggaccaagaaactggctgtgccgaattgtgcacgtcaatcaacatctttgtggagcctgcgatcggcgcgtt

SEQ ID NO: 158 - DNA, 500 bp, Homo sapiens
tccctctggacttcgggaagaaccaatgagcactcactagagtgagaatagccctgagtggcacttggcatgaccaggatttctgagctgcccttccctggcgctggtgactttctatgtgcctcaccacccaccaccacccacacagccagagcaatggagctggcacccggttgacctgggattcccaaagggatcccctaggtccccagggccagcagctgtgagaggtcatcagcctctgatcaccggtctccaagagggtgacctgacactcactgtaagtagagataaagacagacaagtttgggccgggcgcagtggctcacgcctgtaatcccagcactttgggaggccgaggtgtgcagatcacctgaggtcgggagttggagaccagcctgaccaacatggagaaaccccatctctactaaaaaatacaaaattagctgggcatggtggctcatgcctgtaatcccagctactcgggaggctgaggcagg

SEQ ID NO: 159 - DNA, 500 bp, Homo sapiens
gctctgtgcagccttggctgagttactgcaactgaacctcggctgcctcacatttgtactaggcacagtgggaaggcggcgggaggtgcgtgctgcggcgccagaacagtgtttgctggtgcttctgccctccaacggcagagggcggaaagggacagggactctgcacctcatcacatacctggtgttttcagggcggcggggctggggacgggacacttccttgctgccgtgagcggggcccacacgcgtcccagcttggagccagcgcacggccacggccacacgcgctcggaaagcgaggccggcgagaaggaacacagaaggccagcgctaactgcgccccagtttctttttattgatttcttttcttttctttttttaagtatggaggctcaagtataagatgtagatttttttcttaagctttacaaaaaaacaaaataaaacaaaaacctccttttgcattccatagaaattgacagaaaagcacctggccg

SEQ ID NO: 160 - DNA, 500 bp, Homo sapiens
ttgctgtgtcctcctggccctttccatgaaccttttgttctgacagggaggacggccggtggcctgggtctcacactcggccacttgagttccccgtgggcctctgcagcctcctctgtgggccacatgtgtgtggtttgggcagaacgggagacttcacaggcctctgctgggagctcgcttgtttattttggaagaattgtttgtctctgctgctgacagtgcagcctgaatcctgttttgttatttcgccgtccgcgtgttctgtcaaagaccagtggccttctgccctcatctgctgcctgttttgttatttcgccgtccgcatattctgtcaaagaccagtggccttctgccctcatccgccacctgttttgttatttcgccatccgcgtgttctgtcaaagaccagtggccttctgccctcatctgctgaccgcctgactgcactaagcagcattagatgacatttttccgtcactgaatttttaggtcaagcc

SEQ ID NO: 161 - DNA, 500 bp, Homo sapiens
tattaatagacatagaaagataaaactttcaattatctttgaaatctttatcattattgcccttcaacagagtctagaagtgaagtctgaactgactcaaaccggttgagtcttccccactattcaaatggggccgcgtcccgattatcagtgcaatgtgatcacttgattttaaacgcaactatgcgtccaaatggctgagtgcaagaggtcggccggagatagggccgagtgcgctgccccaagctgcgatccctgccaagcactcacggacaatgcactggtttcctccagggagcgtcttccatccagggcagcagtaggagtggaatctggagccgcacacgttgggcctgtgatggacaagcgcggtcacgtaacagataggtagagggatgcagcaacatataaacggtcttcgtaagcaatgccccgagcgagtagatttcaggacaacaaacaaatcaaaattacacttcaaattattggagatcgggagg

SEQ ID NO: 162 - DNA, 500 bp, Homo sapiens
ccagtctgaagaacagactgacaaggaaaatgatatctattttactcacttcagctctaaaaaatttggggataggatataaacatatccctagtaaaagacacacttggactgtataagcaagggaatgctaccacagcctgccagcagagttgacgtttctaaacttagacgtttggctcaaaggtcacttgtgacaatggttacagctgtaagagcggatctgatggaaaaggatacatagccccccgtattgatttcttactggtttgtctgcaaactaccctgtccttagatactgcagataaagatgagcaatcattgcggaggtaggatagtacggctccaaaaattcagaatcttgaaactcaagaaaatcagagaggaattatctttatatgaaaacacgtaactataaagagcaccaaatgctgtaaaattactttagtatcagtttctcacaattaccatatcccaaatgaaggtaaacatgcctcacc

SEQ ID NO: 163 - DNA, 500 bp, Homo sapiens; identical to SEQ ID NO: 17

SEQ ID NO: 164 - DNA, 500 bp, Homo sapiens
caggcactgtgagctgggccagttgccccgcttgtgctcctaccttgacatgtgctctggtcctccttgcccaagaggtgtggggatgggtgtggtggaggcacagtccggggttggtctcgcctgccgcacgcctgttcagtagccttttaatgaactcagtgactcagcgctgtccctcccccaccggcctcggatctcattcctctcaatcgcactgatgcccatgtgacagcacgttgtctccaccgagactaatcccttatcaataagagctttcagcacggcccagaccagattactctgtctcacaaccactttgctgacctgcccggggggccaccgaatactccccgagcgcatactatttacagaagagtcaagataagccggatcacttggcgtgattatttcgcttccaaagtttgtggctttaacaaagcaaacccacattcaaccactcaaccaggcgccgtgcaagccaccagaatgaaaaaaaa

SEQ ID NO: 165 - DNA, 500 bp, Homo sapiens
taaaaatacccttgtgaatttggaacaagggagatattctcctaggcgagatcctttcttgccaactccgtttcccttatagcaaatgtagtaaatgaggatgaagtccctttgagagcatgtgggggttgggtgaccaagggagaccaggttgttcctgtcacattcctagaggaagatgagtggataccccgacacccagtgcaaaaacttttgacctattatgtactcagttcaattgggtgagaccgaagatcttgatttcattcatctgtgtgtcttaaaaacacttgtgtctttaagtctattatggggctttgcttattctttgagtcttggaaagttatcatttgtgcattttaaatttagaaaacctttattaatcgttggtgtggggtcacgctatcaggaagcctgtttactgggttcccttcaggccatcaaggggtttacacaatatcccaggaagttgtaggttgttatctttgggcctggagctt

SEQ ID NO: 166 - DNA, 500 bp, Homo sapiens
aaacagtcccagatcccaaggcttatctgaggcttatctgaaaagaacatctcccgcctgttttaaggccaactgcatgagaactcccacctgccctggcagaagcgagataaacctgctccaccctgaagccggctctgaactagtggactccaatcacagcacacaggaggacagacggggtgggtgggagtgcagagccaatgcctccgaggcaagcggtcgcagagcatgcgtgtgtcccctttgcgtgtacatgtaaccggacacacgggcgtggcacctgcagcgttcagggaaccagagctcggcaaagatcactgttcttctttcttgatgcaggtgaacctgtccttggtattcagcccaagtcctcagcggtgggggctcacacactctgcccacccaacccaaggccatgaccacaatctagaccacctacgcacactgagctgcggggccaagtggaggagacaccggcaaacgctctctggcgtctg

SEQ ID NO: 167 - DNA, 500 bp, Homo sapiens
cgctgcactctggcagggtgtcccacagagctagaacagctcccacccccagtgttatctgctctggcagctgaaatggagaaaaatggatgtgtgtctcaagggagcccagcaaggagaggagagggctctcctgttttggttacatttccgcccctggttgagtgcctgagccagctgtggcctggtgtcatggttaatatgctgctgcagtcgctatctctttgggaaaataccacatgccgtccgcggcctgcccagctggtgcagagggaggcggaaaacacacagggcgtttatttatttattgatctagcctgctgacctgctcggcgggggccgagctgactcaagctgcacatatcctgtgctcagcacagtccgccgttcccctccttcacggaagctgcaggctaggctgctgggctgggaggggtggagggaagaatccaaccccagatgcacagaagttctgtttggtccaggtgggaaagggtgcc

SEQ ID NO: 168 - DNA, 500 bp, Homo sapiens
tccgcacctgaagaccggctgtgcccactgcccctgcggacgctccccagtgttcgcccttggagatttccaagtccagatctaaagcacccataatcagttaagacccagggctccctctagtcttatccaaaattagccctatccgtttgaaaggcttgttcaaatagaaaaggacaaaggaccaagaaactggctgtgccgaattgtgcacgtcaatcaacatctttgtggagcctgcgatcggcgcgttgtggggaaggggctccctccttcagggagatgattctgtctcctggaggcaagtgtgggagttcagaggactttactaaacatattgttttaaaaatccccgtccttcttgccaagcccctgtcccacaggtaataaacaagaagccgggcccgtctcgccgcccaggagggcagagcttgcagtgccctgcggctggtaaggctgagggtcgcccgcttgcagtcgagccgtggtgaaccgagagt

SEQ ID NO: 169 - DNA, 500 bp, Homo sapiens
aaaccccatctctacagaaatacaaaaattagccaggcatgacggtgggtgcctgtaatcccagctacttgggaggctgagggggaagaatcttcaacctgagaggcagaggttgcagtgagccgagatcgtgccattgcactctagcctgggtgagagagcgagactctcaaaaaaaaaaaaaaaaaaaaaggaagacaatgggtaaagtatcagaatggtaccagcagagagtaggtgctttgtaaacgctaggatcaaattcctatactgtgctacagtcagcgagagccaaacaggacacaagtcagaaccttcatttcacttcttggaaataagccatagtcctcccgaacgctctgtctaattgcttatggcccatgttttaggatataaaagagaggaaggctagtaaggatcccccaaccttttaatttttttaactgggggtgcaggggactccaattagggcagtggcgccaagaaggaaccacaacagc

SEQ ID NO: 170 - DNA, 500 bp, Homo sapiens
gagttaaagccgaaatggaactgacatcatagtcttggagacgaaatgtataaccaaaagttttagcatattctgtaaggagatctgtcatcataaggcagttatctttttgggaccgaaggagtttaacaaactgggcagctagagctttgaaccgctccacctctgtcagagtaaggatcttttcttctccacattccaatacctttgaaaacacacggggggaggaaagggaaaataaacaaatcacgggtgtttacagaatagcaaaaaaagtatgcagctagtaatgaaaaaacaagtcagcgttactgaatgggtataaagtttcagttgtgtaagatgaaaaagttcagaagatcggttgcataacaatgtgaatgtgctgaccactactggacaggagatataaagatagttacgaaggtaagttctatgttatgtgtattgtgccacaataaaacaatttttaaaaagcacttcagtagtaaaaaaagaaa

SEQ ID NO: 171 - DNA, 500 bp, Homo sapiens
ccccacccaggccaggggcgggccaaggggcgggccttggattaggaggccaggccagccaggcatcagggctacctctgaatccctggcaaagggatcttggttgggggtggggctgggccaacagtggcccctcccacgctgtcagcactagggcagggctttgtggccttacctaggctggaggaggtgggcaggggcagaccctgctgggcaggcctgtttgtgacactggagaccgggttctttcgtgtcttgtgctcagggagtgttctttgtccacgtggctgcatctgacattgatgggccctaggcactttactttcgtggatcttttcctccttaaaaaaaatattttaaaatatggccaggcatgccaggtgcggaggctcacgcctataatcctagcactttgggaagccgaggtggcagatcacgaggtcaggagatcgagaccatcccggctaacatggtgaaaccccttctctactaaaaataca

SEQ ID NO: 172 - DNA, 500 bp, Homo sapiens
tatacaaagaactactgattatgggtctctacgagcaaaaatggcagaacacctacagggcacaggggagatgggagcagggattaggcttcagaatacttctccaaatgagggtgatcagggcccgacatttcactgctctaaggctcagtatcttaactatcaaatgggtacaatggggcacaaagggttactttgaggaataacggaggtgagcaatttccaaaaagttcattcctttaaaaactgcggagcacattttgtgtacatgctgtttttattgttactcatgaagacgcgggggaagctttggttgtgtaaagctgagaactgcacccaagcttccccgttcaccccacctaccaggggatttgggctaaattcctggcctggcccacaaagaagaccaagcggtcagtcccattccgtcccatcctgatttacaggaactcacaccagcgatcaatcttccttaatttgtaactgggcagtgtcccggg

SEQ ID NO: 173 - DNA, 500 bp, Homo sapiens
ctgaagtccttgcaaaggcacgggagcaacctaggaaagggggttcctggcagccttcagccatgtcccctcaaagaatataaaccagcctctgtccagagaagcatccagaaagagcccgccaggagccacggggacaagggcacctgctctcacccctgctccatggaaagtgcagtcacagtttcttaaaggggaaaggtggaaagcttcattacttacctcgtaacagcagactgccaccacgaacgataaccacttgccacaggggaattcacaattccaggatgtttttcatttgcttgcggagttatcggaagtgactgtgatgggttcaaccaccttatcaataattaactcatacccagggcttatcaaacagcttctgactcctttagcttccatttaaacacacaaacacacaaacacgcacggccttcacaaatagaacttctccaagaaagtggcaaaggaactagtgatagcattctccacggtca

SEQ ID NO: 174 - DNA, 500 bp, Homo sapiens
gctgccctgagccccttctccacccgggccctggcgctcggagcccgcgccgctccctcgagtcaggccgtccagggctctgctaacagctgtttaaaggcttttgctgttcagtgctctgcggggatgtttgttccaggcccatctgcctactttaaaaatacataagtgaagcacacacacccagcttgccacctctggctggggaggggcgggctcggcggccctcgctcgcacttgggaaggaaccggcacccaggagccgcacccgtgccccaacacccgcaccggctctcctctccagaggacgcccctggcttcccttggggggggcggggcgcagggcccccgggccccctttgtaccggacagggccgggccccccatttccaagcgaggtctgcctcttccccgcttcagttaatctttgttccccttttctgctgagaggagaaaaaaaaaagagagagagagaaagaaagaaaagaaggaaaaaaggc

SEQ ID NO: 175 - DNA, 500 bp, Homo sapiens
tgattactggcgtcttcttatgtggaatcattttccactgacggagcggttgtatgatctaattgcatattattgcgtgtgaaagaagtttcaggacctaggactggtggacacggcagtagccttttcataatagctttttgccatgaaggaattcggggtttagagagcgatgggggctgcagagagccaggaagtctcgcggaggactcgggaatcacgagtcctgcctgaaaccttagtgttttccgcacattccttccactgagggaacctcctcacccacttcagaggagggtgcgaaagagcccaaggaaactcagatgagaggcgcaaagacctctctgcaaagcattttaattctccatcctggaagaggcactgagttccagagtcacaagggaagggttctctcctctgctcaagtgaaggccaaaagaacaaccgtggtcccagctccgtgggcctccatatcgctctaaagcttcccgcctgggctg

SEQ ID NO: 176 - DNA, 500 bp, Homo sapiens
ttggacaaggacaaggcctgatctgggtgcactgagacctccctcccctatgcagggcccagagtgacaaagagggtctgtgtccccttccctttgcagaagcacatcaagcccgcacacaggctctaccttcctctacccaaccccctctccactcctgcagacccccgccttcctgcaggtccccctccggcccctccctgctccgtagggcacgtagacccggatccccagctcccggaccccttccgactgctcccttcgccactcgcgcggcttccactcctggactcggcctccacccctgggcttggcctcaaagcctcctcagttgtcggccctggaaggtgcccagcggcggcagcgccagacgcgccccgttagctcagcgtcgctgagcatccgcagccgccaccaggccccgcccagcggccgcagccagccaggccgcgcccgggacgactgcagagcgcggtgagtgaacgcggccagagggaggg

SEQ ID NO: 177 - DNA, 500 bp, Homo sapiens
gccccgcccccggcccgcccccgcaacccgagccaagagcggggcggggggtgcgggctgggggccctggggccccggggggggggcggcggtcgcaggggctggggggtgcgcgggggcgaggctgggtggggggcagggagccgcagagcgccaaggccatgctgaatgcccgttctagagaattcaggggccccatcccgggtttctggggtgcccgggcggcctgtgctcgtgagctggggtctccgggcaggcaggggcaggcgggctcccagcgccccaccaggaggctgcactgcgggtgcgccccgtctgagtgcagatgcaggtggcttggggctgagtcggggggtccttgctggttgttgcggctgagggggcccctgggctcgggcggggcgcgcagccgccacctgccccagcaggaggagccggccacgcggcgcttggagcctcagccagatcccgagcgccccccggtgccgcgccggagcccc

SEQ ID NO: 178 - DNA, 500 bp, Homo sapiens
ggctcagagtgcagctattcctgcagccggccttcctattttcagtaatctgattaggggtcgatgttggtgggctcggggacggcttctccgtgaggtcgttatttagcgcgcaccgggtcgcctgagcccggggtcgcggccaaaggggtaatcggctcccgcagtctcagcccttcccccggggctcggggcaggattgactgcgcaaccctgcggcccctgtgctctccgcggcctctgcgaccccgccccgccagcctctccgccgctgggctccaccctcccgggctctgctgtagtctgagaactccgtggagaatgcgaaccgagcggcgaacggaggcttcctgcctcccaggttgtgccgagcctcagacccttctcccttccatttaccaccaagtctctagattcaaggtcaagtcaaaggagcacagcccgtcttacccctgggactcccagcgcccagcacggagcctgggatgttagagcgctgg

SEQ ID NO: 179 - DNA, 500 bp, Homo sapiens
ttggagctcccgggcaggcggtggaaacttggcgcaccgtgcccactctccggcgccgctccgacagcccgacgggtcccgcggccaggaagccactcggcgcccctcgccgtcactcgacccccggcccctttcggactccgatcctcccgtccccaggccacacggcgcggaaaggggatgccgagcgggacgcgcacgaccagggcgcccaggacgagggcgctggaggagactccgggcagggaccggggtcccaggggcccgggccggggctcaacacccacccgatggggtgcgggcccgacggggcccgggggtgggagtaggggcggcgggggcccgcggaggaggagtggggataggccgcgcagggggtgcccgggaccccgggcgcaagctgggaaagaggcacgcgggggcggcgcgccggggccgggacaggcgcccgtcctcacctgccgggcaggtgtcccgccgccgagtcgcgcgcgtcgctt

SEQ ID NO: 180 - DNA, 500 bp, Homo sapiens
cagcttgagggctgggtgggtgggtaggggtacatccctacccaaggctgaaaacaccagctggacagcttcccaagccagaatccaggcctgaagcacagccctcagccacagccctctctcactgccccccacacacatgtcctccccagacccggagaaaggcaaacactgtggccattcagagcccagcccaagggagggctgccccctcccagggccccttcctccttggccctttgtctatcccggcccgtctgggcatcagggcaccgcccttcctgtggccccagctcccctccctgctccagctgtcgagtagcttcttcccctcccccagcccctctacctcagccctaagtgactcacccgaggttccaggcccagatgcccaggcagtgactcagcggcacaccctcctcccccagggccagggcagcagcagtcccagagcagtaggtggaagccccagcccagcctggcagggaaagcactggcac

SEQ ID NO: 181 - DNA, 500 bp, Homo sapiens
tgcgcgccgcgcccgcccgcccgcccgcccgcgggccccctgccagcccggcccccaggcgcgattcgcccgccccgccccgccccgccccagcccgccccgctaactggggctcaccttccctaagccttggcggggaagggcgaggcaggttctcctcacttcccaaactgggaaactgacgctccgggatggcgctcgccggaacccggcccctacccagcgctgggagcccgctctccccgccaccggagcggttcacctcccaattctttgcatggcttgccctagcgatgcaaagaattgggaggtgaacccagcctactcagcccgtaagtcactactgaaatgtcacctcctcaacgtgtcttcctcaaaaccacccgccaggtaatcacagatttgtgtgatcctttgattaaagtctgcccctgtcctagacccgagactcgctgggggccactgtggctgcttcctctcactgcacgccccgagaatgg

SEQ ID NO: 182 - DNA, 500 bp, Homo sapiens
agaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggctggcgtggtctgagtcttttagttgagtatgcgtgggcagtgccactgcagcaaagcccctcgatggagtagagttcctgccgcaaaggggaggaggtgggtcgcagaatgggctgactcggagggagtttttaattttggctttacctgcttctccgtaagatttcatgacttgttagccacttaactcttgctcgtaagcaatctgtgtaaaatttaaccccactttgtccccaggttgcgttggaaaatgctttttcaaaagagcaaggtttgcttttg

SEQ ID NO: 183 - DNA, 500 bp, Homo sapiens
ggcaggagggagggagggagggagggagaagggagagcctagggagctgcgggagccgcgggacgcgcgacccgagggtgcgcgcagggagcccggggcgcgcggcccagcccgggggttctgcgtgcagcccgcgctgcgttcagagtcaagttctctcgccgggcagctgaaaaaaacgtactctccacccacttaccgtccgtgcgagaggcagacccgaaagcccgggcttcctaacaaaacacacgttggaaaaccagacaaagcagcagttatttgtgggggaaaacacctccaggcaaataaacacggggcgctttgagtcacttgggaaggtctcgctcttggcatttaaagttgggggtgtttggagttagcagagctcagcagagttttatttatccttttaatgtttttgtttaatgtgctccccaaatttcctttcatctagactatttgattggaaatatgtcagctatgatgatgactttctggga

SEQ ID NO: 184 - DNA, 500 bp, Homo sapiens
tacactctttcctggcgttcaaggcctccctcccagctgcagggagtctcatggaaattcttggcccaggggagagctttgggaaaaccaaccgggcagcaaaatgcagagggattgttctcgggaaggggctgcaggtgggttagggccaggcccaggaaatggccaagggacttggaccagggaggggagcagcggcggaggtggaaggactgacccgggcgcggttgcgggtgggagggcgctcgccggcagaggatccagcgcggacgctccctgcagcgccaccctgcggccccttcgagtttcggtgcggcagcggcgagtgcaccccgcggggctggcgctgcgaccaggaggaagactgcgccgacggcagcgacgagcgcggctgcggagggccctgcgcgccgcaccacgcgccctgcgcccgcggccctcactgcgtgtcccccgagcagctgtgcgacggcgtgcggcagtgtcccgacggctcggac

SEQ ID NO: 185 - DNA, 500 bp, Homo sapiens
agtgcggccaggtgcgcagcaggtcgaagagcgcgtcgccggggcagtcggtgcgcaccagctggcggtggcccagcagcgcgtagtctggccgcaggaggccggcgcgcaccgcacaactcgggagcgtgtcgcgcaccgtgcgcagagcggcctcggtgggcagcgccgcggtgtagttgcccactatggccacgccgaagccccgggagttgtggccgagcgtgtgggcgcccacccagtgccagccgcgtccctcgtacacgtagccgtccgagcccaccacgaaactgcagaggggagggagaagcaagcaccatgcggcgtgagggggacccgggcccttatccgctcccctccccgattctgttggtgtgccaagggccaccgaccccaagacccgcgcggtcgcgctgcctgtgtcccatccagctctgttccactctcacaccagctgccactccaggaccgttcggtttctctggatccgcccttcagta

SEQ ID NO: 186 - DNA, 500 bp, Homo sapiens
tggagtgcagcagatcaaggctcccactaagaactagaaaggccaggcaaaaatataaaaatcatctctttaatggcatcagaaagctacagaagcaacaaagactaaaggggttaagcctcaaaagaggagggttccgtaggataagcagaccatctgcagcccgcagttcccaagtgcttgttcgtgctgggattaatgacacacgggagattcgaagggcagctaatcttggcaagaatgaagacgcgaaagctgatctcttcttcaagactgtggcaggactggaagctgcgtgaaaacgctggttgaagagctaatttgaaacttccggaaggcagagcagaattgtttacctcgctcagggctaaggaaggggagggctctagttgtccacagcaaactgtctgttaatttcctggaggattagttcctagaaacaagcaacacagagataggctcaccgaaagggcagcttgtcctcagctcagctcagtccc

SEQ ID NO: 187 - DNA, 500 bp, Homo sapiens
agccctaaataccccagctgctgttcctccccatcacccagccaccggattctccattcacccctttctctcacccctggagccccgtgggtgggggcagggcatgagttccccagtccccaaggaaaggcagccccctcagtctccctcctcctcattcccttccatctccctcccctctgccttttaaacccatcccctccgattcccctcctcccccctctctccctggtgtcaactcgattcctgcggtaactctgagccctgaaatcctcagtctccttggcggggaagattggctttgggaacaggaagtcggcacatctccaggtctccatgtgcacaatatagagtttattgtaaaaagcagcagctctctgtctcctttttatcccctcagtggtctccacttggttggagaacagggatttccagaggtggcactgtaggaggatcctgggagcacccgtgtctcccagggaggaaggtctgtgggcagc

SEQ ID NO: 188 - DNA, 500 bp, Homo sapiens
cgttccccgcaccctcctggcctgaccccggcccggcctggcccgcctggcgccccacttccccaccctgtaagtagcccgaggtcccggctggggtcttgggacacccctccaggctgcagcctccaccgtccctgacgtgcactcactcaggccggacgccagcgcctgttcgttggcccacatggcccactcgatctgccccatggcgacacgaacccggctgggacactgctaggcgcgcactgccgcccctgcgctcccggccgaaccccgccccgcccaggccccgcccccagccccccaggtgaccgcggctgggcggagacccgcatctgtagggtgcagggctgtcccggagccttctgcccccgccctctctagccacgccgaggcataggaggggccctgcccggcagccccagcccaggcggggagttcctgcgcttccccagggcttcccaaacttcagctctcaaacactgacaagtgcccctgcc

SEQ ID NO: 189 - DNA, 500 bp, Homo sapiens; identical to SEQ ID NO: 38

SEQ ID NO: 190 - DNA, 500 bp, Homo sapiens
tgtcctcatttattctgaacattcagaaataaaaaactaaaataagaaacaactttttttttcttttgcagaagcaaagggactcagtaccacaggaagttcgcttttctgtgtcactatatcaaaagctaccacaaatgcagacaataacggctctttaatattaaagggaaaagctaacctgtccagctacagcagcaaagtaaccatacagcggatcctgagtttgtccgggaaacgcaggccctccgggagcccctccatactgtgaaacaggaaacacatacacgtcattctgccgaatcaagttttcttctttcaccactgagggcttttgtgcaaggccagacaactgcccgcctgcccgcccttcacaaggctcacctccccaccaccgggcacactctgccaacactccacccctctcttccattcacaccccgtaatttaaaaactggcgacttagaccataaagagttgctgtgaaagtgatgtctaca

SEQ ID NO: 191 - DNA, 500 bp, Homo sapiens
tccgccgtgagtctggggagactgcgggtattctggggagagggctggttccaaggaccgcttttcccggccctccctggctgcgtagagggaagggctggatctgaaagcggagggcggggagttgccccgccgcgggccccacctgcccaggagctggggatgcctctccagaatgacccccgatctccgtgttccccccaggtctgtccacccgcaggcggtagaaacacctggagcgatggaatccggccaggtgctgcagctctgacacggcggtgggagggaaggagggaggaaggaaaggcgggagagggagggggccaagtgccagagttgaagggcggcgaggggtggggctggacgtcccccctcgcctctcacccttttcaccctcacaggactcccctggcacctgacatctcccacgctccacctgcgcgcccaccgccccctccgccgccccttccccagccctgcccccgcagactccccctgcc

SEQ ID NO: 192 - DNA, 500 bp, Homo sapiens
cacacttcagtacacaaggaaaatatctctattaatctgtgcactaatcagttatgaaaaaggagaaatttgtgggtttctgggtaaaggcttggagatgggggtgtaacagggaggagaatgggggggtgaaaaatgaaatattaagccagccattttgtttgaaaaggggattttcccccctctccctttctttatggagggggtggcggtgctggagggggggttgttttaaaaataatttcaaggcggccatcttagtgcctcagctctgagaaatatttctgagcgcccccctcagaatttaaatatatttaaagcaacggagaggggggcagagagaagtcgaaaacttttatatatatacatatatatatatatatatatgtatatatatatatattttaaatccccctttcttgttctcttgggaggaaagagagaaggaaaaaaagtctttcctcaattttttccaagacaatttttgggggtggtttggc

SEQ ID NO: 193 - DNA, 500 bp, Homo sapiens
gaggggcgccgcgctccgcagggtctgcaagggaattactgggggtctcagaactcctccttccagcccgcggcctgagggtcccgcccccgttccccgcaccctcctggcctgaccccggcccggcctggcccgcctggcgccccacttccccaccctgtaagtagcccgaggtcccggctggggtcttgggacacccctccaggctgcagcctccaccgtccctgacgtgcactcactcaggccggacgccagcgcctgttcgttggcccacatggcccactcgatctgccccatggcgacacgaacccggctgggacactgctaggcgcgcactgccgcccctgcgctcccggccgaaccccgccccgcccaggccccgcccccagccccccaggtgaccgcggctgggcggagacccgcatctgtagggtgcagggctgtcccggagccttctgcccccgccctctctagccacgccgaggcataggaggggccct

SEQ ID NO: 194 - DNA, 500 bp, Homo sapiens
accagatcttgaattttttcgcttgaaaccatcctggaccctttaattcaaccacaagtttgctttcgaactgaactcacataaatacgagtaacactttgtcctcatttattctgaacattcagaaataaaaaactaaaataagaaacaactttttttttcttttgcagaagcaaagggactcagtaccacaggaagttcgcttttctgtgtcactatatcaaaagctaccacaaatgcagacaataacggctctttaatattaaagggaaaagctaacctgtccagctacagcagcaaagtaaccatacagcggatcctgagtttgtccgggaaacgcaggccctccgggagcccctccatactgtgaaacaggaaacacatacacgtcattctgccgaatcaagttttcttctttcaccactgagggcttttgtgcaaggccagacaactgcccgcctgcccgcccttcacaaggctcacctccccaccaccgggca

SEQ ID NO: 195 - DNA, 500 bp, Homo sapiens
tctttaaaaaaattttgccttggggtatgggagaaagagaaagagaggaagagagagagagagagatcagttgatgtaatgaacagttcattgtgagcatgatttcatttcgttcctttgtcctccttctatgagtaagagagtgggaaaagtcaaaacgcagctccatggagataacgtctcatggtgagtcactgctttgctgaaatgattcttgtactctctgctacacgacaggaaaaatgttaacgctgctttgccattaaagcaagcatttcatttcctgcttgaaatgccaactgagcaagatttccattcacttctagaaaaagacaccgcagcatattgtgcttcttcaacactgaacctctcttaattttcagtgttttggtaaagataaggtcattattgctcattagcaatttatctgctttttaaaaattcatcttctctaaacaaacgaaaaggacagaaggtgggaagcacaacaccaagaattc

SEQ ID NO: 196 - DNA, 500 bp, Homo sapiens
ccagggggcagaaagcctctgatatctcaagctttccttttcctggaaagtggggagacaatacgtgtcgggggtggggggagttacacacgcacccgcaactggcggggagagacagcgtggtcggtgtagatgcacagtttttcgatggtcaggggcgtggtctcgcgcagcttggaggccagcagcatgcagaccgcacccaggagctgcaactgcgcctttcgggtggggacgcaagacaggtagcgatccaggtagttcatggccagggggaagacttcctcctcacagcgctgctcctcacatacctgggggagggcgcacagtcactgctgggtctggagcgtggggaacacagcagcgggggggtgggagcgctgaagtgaggtgggatagggagcaaaaacggcagagagggtaagctacttagagagacaaggaccaataaaggaggaggatgcgccctccccaaggtgacgccccccacttcctctgcg

SEQ ID NO: 197 - DNA, 500 bp, Homo sapiens
ccgccaagacttccaataaaacgtgcgttcctctcgacagcactttgtcggtctcggtccctcagcgcgaaacgccagcgccactgggccccagcagggggcgccccaccctagaggaaggggcggggacgacggtggtgggcgggggcgggggcgggggtggcctgcacgggggcgggctccccgggcccccattggctgcaggcccccccacgccagggctccccccagctcccccccacatcggtccgtcctgcttccagctgctgcagcgcgccttcgccgccaaagcatccagcagccccctgctccggcccagcatggcgaccccgacccagacccccacaaagggtgagcgtcgtttggggagggggttgcaggggggctccgggatctgagagcctaggagagagggtgtcgggagattcaagcaatggtaaggcaagggagttgggggagggaggtccgctcctcctgtgggcggaagcccctgtaatgcg

SEQ ID NO: 198 - DNA, 500 bp, Homo sapiens
gccagctttaaatgaacattactgggttggcctatgccaggcaggcgcgaggtctctattccccatgtgacaatcaagctgggtgcgttcacgcccaggatgctggggttgtcccacctctaggtttggagtgggacgacgaggagaagcaatttgttcaggagcagagaaagttcgcttggctgtgactcatcgcctctccattgagagtctccggcgggtccgtgatcatcggacacgatcatgatccgtcctcaggccccgcctgtgcagagtgcgcggaggccaaggagttattggcagaaaagcaagagcggaatgagcttgcgtacttgaagtctgtggccgtctgccaacatctccttcaaatatgaacattcttattttcgctctggaagtttttgtcaggtttattgcaaatgcaagggtggtgagcagacagaaagaaaatggtatttactgagctggaaggactgttttctcaaccgtttctcaagagc

SEQ ID NO: 199 - DNA, 500 bp, Homo sapiens
ctcccactcccagccgcgtggcccaacctctcctgggcttcactgcaaatcaccccttcctctcccgcctcctaagtctgtcgagcagacctaggggccggctacagttgggagggcaacgggaaagatcaagccacaatcattccgaattatcgccccagacacctccctagactctggggaacgaacgcgtgctgagcctccccgccgctttggagacggggctagattttcgttgcctccggctctcgacaggtgcaaaacaatgaattccaagcctcggaagcaaagaagcttaggatccgacggtggccgcaagatctcatcatggatctgacccctgctcagcgcgcgccatttcgtcgttgccaaacgaaatcaagccccgcgtgcgctccaggggcgaaggactctggactcaccccgaccaccgggagagctggcccctacccacctcgggacctcacagcacgccctcaggccgtgtcgaaaggaaggac

SEQ ID NO: 200 - DNA, 500 bp, Homo sapiens
acccacagcagcagttgcgtgatgacgacgtgggcgagctcggccgccaggtggagtggggagcgcagctgtgggtcctctacgctggtgtcgagcggcccgtgtcgcgcatgggccaaaagcaggagaacggtagccacgtcctgggcctgcacggcggcccacagctggcggcccagcggctcctccgaggtgctcagcggcgccaggaacagtagctgctcgtacttggcgcgaatccacgactcgcgctcctccctgcaagaccagggatcaacggaaaaggctctagggacccccagccaggacttctgcccctacccacgggaccgtctcaggttcgcacaccctcagcaaccctccccccgctctgttccctcacgcttaccgcgaagagtcccgcgagggcttggcacggcctcgcgtgtcgctttcccacacgcggttggccgtgtcgttgccaatagccgtcagcaccagggtcagctcccgtggccagt

SEQ ID NO: 201 - DNA, 500 bp, Homo sapiens
cctcacccctgccccagaatacctcctcggccctacgcggcctctgctcttctctcttggagccaggcagccagcacggaggcagcctcgataactcgctaacgtgctgcccatgctgttcttaaaaatttatgactgtgcaccatgaaaaatccagctgaggagccatcattagcggtgctgcctccctcccccaccagagccaccctcgtaaattgagatttatggctgcggcaggcggggcgggggcgtgtgcaggcaatgaggatgttgtgggggagacagggagagaccaatgaggcagccgcggggccaggggctcccccctgcggcagctccggtttatcgcaggctgcagtgataatccctgcggagagtaagggccggcctgggtgtcagcgcagggctagatcccgcctagcagtgggacgggacaggtcggggaggggcctaaaccaatcaccggctcctttcggtgtatagggccagatcttgaggtg

SEQ ID NO: 202 - DNA, 500 bp, Homo sapiens
tagaaggagagaggcagtgttattactaaggctgagtcagtaccctgtgagcacctgccagacagaaggccccagaaccttgcatccctctccttttgcctgcagaagctcaccctgcctggcctaggccacagaggagatgcataaaagccctccaccctctttcgtatgtcgccatgcttatcttgcaatcttgagctataatctggctgcctgaaaatctaacaggtgtaacattaaggccacaatcgtggtgtgctacaaagattttatctgcttttaacattaataaattgtgatgatggtgtataaaccagtcgtgtgaactcagttcatgggaggcatagtaactcatgggcgagttaataaaacaagttctaaagctgcatagctgggcatcagcatcaggatcagaggcaattttctgtaattatacttcttccagaaactacctttctacattgctgaggctgaagtcaagaaatatagaacctagagct

SEQ ID NO: 203 - DNA, 500 bp, Homo sapiens
gcagccaggccttcagcctccgtaacccccgctcagggtccccaccccctgcagccctgtccctccaggatgcatggccttgtcctgtgtgggggtggccgagagcactgccccagccctgggtaccttgggcaggaagctggcagaggccagggctgccattcaaacaggggcaggtggttttgccaggaggaagttgacagttcaacttcaaacatgggtgacgcaggccccacactgcctgctccccgtcccacccctccctgagcacgccaccccgccctctccctctctgagagcgagatacccggccagacaccctcacctgcggtgcccagctgcccaggctgaggcaagagaaggccagaaaccatgcccatggggtctctgcaaccgctggccaccttgtacctgctggggatgctgggtgagtacccctcccaggtgtcctgcgaacacccgggctcgctccagtgcaaggaaggagttcccagttttac

SEQ ID NO: 204 - DNA, 500 bp, Homo sapiens
agagtctattaggctgcagcaaaggaagtttattcaaaagtataaactatccaagattatagacgcatgatatacttcacctattttttgtctccttaatatgtatatatatatatatatatatatatatacacatatatgtgtgtgtgtatgtgcgtgtgcatgtttaacttttaattcagttaaaaacttttttctatttgtttttcatctggatatttgattctgcatatcctagcccaagtgaaccgagaagatcgagttgtaggactaaaggatagacatgcagaaatgcattttaaaaatctgttagctggaccagaccgacaatgtaacataattgccaaagctttggttcgtgacctgaggttatgtttggtatgaaaaggtcacattttatattcagttttctgaagttttggttgcataaccaacctgtggaaggcatgaacacccatgtgcgccctaaccaaaggtttttctgaatcatccttcacatg

SEQ ID NO: 205 - DNA, 500 bp, Homo sapiens
gacatctgtcatccctgcgttgtctcagagcacagggacttgcctgtgatgtgtatacaaggatcttctgcacacatccctgtcagttcttctgccaggaagcccttgatgtcttctaacctttcattgtgaggaatgtacatttaattaccaggaaaatgactatgatgtaataggtcaagacacgcgcagcttctgctaaggaggggctctgcgtaggagcggcagtcgggggagcgctccacaacccggcgctccaagagagcccaggcgtccggagcacaacaccagcctccattccttcctgctggagtgggcagtaggtccaccagtaaaaataagtcaattataaaggatataaacatgcttcagacattcagaaatctagatactcctcaaatcactagtttcgttataggatcaacgacttttctttggattagaatttcctcgttagagggatttggcatctgtgatttctgattttgtgtgtgtgtttg

SEQ ID NO: 206 - DNA, 500 bp, Homo sapiens
gtcgctgagtgtggcttaaataaaaagcatgtttatgtgggagagaatgtgtgggggttgctttcgcattatggaattcttaaaattgttgaaccgggaagatgttattcagaaacccctggtggcttcagcttgctttttgtgtatttcaggtttcttttttcccccatttttaattatctctggaaaaactcaagagtcctcccctgctcctaaaatagttataaaattaatgtgctgtactcaagtcgttactccacgtaaaagagtaaaagactcccatattaagcagagaagtccagcctcctctctctgagtgtgtgaaaaagggcatagactggagactggatctttcttctaagcctaaattcttagcttttcagccagcgatttatagatggtagaaccaaaagtcaccaccagcattctgtctgtatgagagcacacagaatcgtgctttcccctgctagtttagtaggtagagagtttacatgggcttt

SEQ ID NO: 207 - DNA, 500 bp, Homo sapiens
gggcaaacagttctgattaatatttcacaacaccattttttttccatattcctttcttcgcgttgttgcttttctctctttttatttttttcctcctcctgagcccctgagagcctggtagagaaacatggaatatttcaccgtctcttgtgtctgcctgctccagtaatcagcggactcaatcacgcttgcagtgtttttatgaattaataacaggcactttggagggctagcgggggaggcaggaaacgcaatctatggaagcttaatgagcgccgtggggagcagctacctccgcctccaaccctgcgacgctgtgctctaaatcatcgcttctgagatcacccacttccagaccagcctggacagcttgtgtgggactcctcagtgaccctctgtccctgccaggtcctcccgggaagcggaatctggaagaggcagcctcaacgcttcgccattttaattcgaaaaaggaaagggagacaggggctctggtttgt

SEQ ID NO: 208 - DNA, 500 bp, Homo sapiens
aggtccttgccggtgtggctgcacgctgccaccaagtggctggcagggcctcaagcttcccgcaggcacggagaggagggctgggatcaggcacttttccactcaattatgccttgaaaagttcccaaatcaagctctttattagagataaataggtatattaggtctctttctaattagcatggcttttaaaattgtgcgcagttagagggagctgtccgcgtgtgctccagctccgtggtggtgctgcgagccaacctctcctttcattcctggaggtgggggacccgccctcatctcaggcctgaagagggctgtgtgtgagttctccacttgtgtgtggggtgagcccggcccatgcacacagctacacacacatcacacacccacacccggacacgcgcctcaggtccccacactgcccttacacacatgcgcccctcacacatgcatgtcccctttgcacacacgccccctcgcacacgcatgccccctcgcac

SEQ ID NO: 209 - DNA, 500 bp, Homo sapiens
catccaacagtacactttcaggcaggaaacagtgagttactcccattcactccctaccaactatagcacttatttgaacactttatcttggtccagctgccagaaaactttcattctcttcccttacatgcagggagccgcctttccttggatatctgaacctggaaacatttaacattctcccaggaaataaccccattcaaagctattgtttttaagtgctagagtgattgacttgaaagtaacttgcgtaaatcagtggtgttgattactaaacacaatggtaattactagggaggataatgaaaacacagtatagttgtataaataatatgtgacaattgaaagtagaacctataatgggcttttaatatcatttactgcagttaaaggaacggagttgggaggtacgtggcttgcgtgcttatgctattttccctgtttcctcatgtggcaaaaattgttaagtaatcacagtattttcgtatctgtacctgaaa

SEQ ID NO: 210 - DNA, 500 bp, Homo sapiens
ctgtcctttgcaacgctgccagttatgcaaagggcaaatgtgcacctcagccctaatccaacaattgcagatttttccctcctcaggggtggggctgtgggtaaaaggcagagaagtgggttgacctttttatatgaaggtcccaaacagccaccccatacctttgcctttctatgcacagaggaggcatcagtgtggtccagcgtgggtgcgagattcccaaggaaatgctcagcaccgctggcaaagcgaaactcgttccacaaagcaacgtgttttaccaggtcaagctgaacctcaggggaatttgatcactttacttgggcagaaggcttgaaggactttcttagatgaaaagcccactgtttaatgggtagcaaaacaaggcttttcttcaagaccaacctttctatccatgatgttaaatctgactgcccgtagtttaaagaaagccggggatggagtgggggctagcatcgatatggctttccttccgatgg

SEQ ID NO: 211 - DNA, 500 bp, Homo sapiens
ggctagggagacgtgcacttacaggttattagacagatgtctggggcatattcagcttacgggtgttggaaaactttcagtgtccaaaggagacccagcaccaggaaggtgctcctgagagctccagggaagcaggagcaggctgacctttccctcggctgcgccgccacgctgtgaaattactgcctatgagtcagactccggggagatggcacgggctaaatataacgctgggcaggctgtccgacgcgtcattaacctttttccttcagaacaaaggcggataacccaccgaacacaaaacaaaagtagcgcataatatgacaaatggccaacataatccgaaaataattgcagatctgaattaaactgtaagatgtgaattgatttcagctcgaagatgtagagagctggaaacaacaatgcgcccctcttgtgacgaggtaaaagagttggatatactgaaaattaactttccctgcctgatcagagagctgggg

SEQ ID NO: 212 - DNA, 500 bp, Homo sapiens
gaaaaagaatgagtgcttttaaattgtacatgctggagttttcactaaccgaaaagtattaccaaaaaatatattgccactcctagagcacaaactgtgatgagtccaacccttttattacaatcaggctttctctaaatatattatgccctgcaggtcaaaatgatttacttctctattttgggacatctgagttctattctactgttgccagtatgttttcagctgtgccagaaccgagcaggtctgcggctcctttgtaacatcaaaacggagacatttatcattgagatttatcatgggacagcctgccagatggtttgggtattttaaaggtgaactgtttgggccttgattagctcatgcggacttctagctaaagacaactctatcagctgctcagtggaaagacactgacgtccccctccccccagctccctccctctgttcttctagtaatgcagaaaatattaatgtaatggcagatgtggcatagattg

SEQ ID NO: 213 - DNA, 500 bp, Homo sapiens
gcatgggggtgctcagagccgcagtgggcgattctctcccttcgcgtgtgtgtgtgctggggttgtgtgtccttgaagcctggagccagggtgttctcggctcggtcctgtgatctgtgaagctcttgtttcttgtcaggttttttatttttcattaatttatctaaaattcagtcttcctgctttttagggttcttagacccgtcagcaagtgaacggaggagcgcgcctggtgtgtggccagccttgcgatgctgttgtgtttgcgtgggcgcggagtctgggcccagctgcactggcggcctgcacgccttggccccatgcccacggccacggaggctgagaccagggcaggggctttagtcccgatgggagcgggggcagggccttgtttattgtttttaatcgcggcaaaaacccacaacattaaatttaccaccttaaccgtttccgagtgtgcagttccttagtgctaagtacattcacgttgttgcacggat

SEQ ID NO: 214 - DNA, 500 bp, Homo sapiens
gtattatacaatcttattttcattatgcttttttttaaaagagtgctctatgaatctgattagatgcttcaaacataaattttaaaacttactcttgcaagttttagagactaaagccacggccaatgttttgatcatatgcctccttccctttccaataaacacctaacacactttgccaagctttctgtggtcaggatttacagatctgtgactcagcccagtgagccagggaacatgaaaagatgtcgctggggagaaatatgcaaggaaggatgggagaggtcagcgcctccaccaagcaggacagactcccacagcttttcctaataaacaagtttccagggccctttgaattcttccagagagaagaggaacgttagcattcacattgaggggaggaacatcacgcacagtgaccacgtgggcccagatcctcagaaaggggagttaaaagctcaggcaggaaacagaactgggaggcgggctggcaccggaat

SEQ ID NO: 215 - DNA, 500 bp, Homo sapiens
tgatattgcttcctgcccgcatcagtagtaagttgtctttgaaacatctttctcctccagtctcagagaaaatgtttttttgacttggcatgctcacagattaaaaaaaaaaaaaaggatgattaaatttgcttttaagttaccaaatgcaccatgcaggtctgtaattgaccatgagagtgtcggggaaaatatgatctatcccctataaatcaggaaaccttaaacaggctctctaatcgtaaatgccgatcctggcagtgtccaaaaaggctcatgtttataaattgttccctgatgttttaagtaagtgcacaaacacaaatcatactaaggacttcagaaaagacttagctgtgtggcaatttattataagcagtgtaattttcatcagtcaggcagccatggactgtaattacctctctaccgaaagagttacaattgctttcattacattttcctagtcatgtgcttctctggattgccacagagacactgga

SEQ ID NO: 216 - DNA, 500 bp, Homo sapiens
cccagggcccagcatggtgcctggcacagagtggatgcttcatgaatctggttgaacctaatagttccctttctacatggacaaagaaccaatgcattagagcaaggcaaagagccagcaagcggctgttcagagaggctttgtttaacagcatcagttgaatgagatttataaggggagtgtggcagttaagactcatttctcataaaatagcctacattggctggttgtgcggcccttctcaggaaacggtaatagtaataattcatacatggtcagtgtcatacagtttcgactgcactttcatagagttcatcttgtctccctctccgagctcaggccttagtggggcatgaggtgcgggtgggccaggcttctgggccacctggactcacccgcgttggatttctcccacgatctgcatgtgatactttttgggcatcttacagcccccggagatagctgttgccaccaccacctgcaaaccccagagtggagaa

SEQ ID NO: 217 - DNA, 500 bp, Homo sapiens
ctacaggaataaaatcaagtgtatttagaaaccggttaatactccaaatataagggttttcctgagtgcataaaaattgacaaagaatataaacagaaaattaaagaagccaatatttcagttaataagcatttgaaaatggtcaaaattgccaatgaatggtaacagaaaacatgacttttaaaaactacaagtgagctattattttacagataattaacggccgtacattttgatgtctgacttccacggcacctggcccacatcccggtctgcctccgccctcccctgcacaggtccatctaccatgcagcccccacggctcgccgtctgcagtgtttcaggctgatgggagaacagtgtttcctgtctttataatgagatgtagattccctatttcaaaaggcctaatgggatagcattttttaaaaagaattcaaattggctaaatttagtttctgaaaaatgtccagtccaaaaatagacctgttccgaaatat

SEQ ID NO: 218 - DNA, 500 bp, Homo sapiens
tgtgtccacctgtgtgtgtgtgcggctatgtgtgcctacctgtgtgtgccgctgtccctgtatttgctccagcctgaatggcaatgaatggatgggataaacacagactcatccatgcttcaggggctctgcctggcccggcccttagctctagctcctgaggctccgggaaggccaaggcgtgttccccagggcttgtccctgcctgtgggagggtgggacagacgggcagaatgcctggcgctaagacgtggacggcagaaccgacagcagccctgcagcacgtggcctggtgcagaacctcggatggagcagggacctcgcttaggccccacccacctaaatgattaaaaaaccttcgagttccttcaaaaatatatcagacacctagccagccttgagtggtaaatcacctaacaagcaaaataaataataaaataatagccaaaaaattagtcaggagatatttattccctatacaagttaaaaatagcatctta

SEQ ID NO: 219 - DNA, 500 bp, Homo sapiens
actcggtgaatgggtggctgacttctgaccctcaaaagatgaatggctcattttgaaaagcccagcaagtgggaagcctactttctacctccactgacttcagaatgaggctgcagtgtagtggagcccaagatggccccgagttgtttccagtcactagcaagatggacaatgggatgactcgctacctgcagctgttttcaataaaaaagctgagtaattacagcagcctctcctggggctcacatgcggcccagcacaaagccaatggaacattaaggacactgaatgagctgccagaagcccttcagcattgggctgccaaactgctcctcctcccccagctcagcgtcattaacttaatcaggtattcattcaataaaaaaaaattgacactccctggatgtaggcaacaccctctgaatgaggcacactgtcaaattgactgcatccggcaggaagtgtgagggcggttctatattcttttaattatttattta

SEQ ID NO: 220 - DNA, 500 bp, Homo sapiens
catatcaaaaccattgaattgtatgctttaaacagatgaattgtaggcacgtgatttatatctcaataaagctgtttaaaaaacgaagcaagaattcttatccccctgaggctcgtgtcagctccatgagaatgtttgcatgcttggttcgtccttatggaaaatagacaataagcaggttcccggcgcccctccgctgtctgggtggcgcatctccaaccccaccccgttccggcgctctggccaggacgtattgcaactctgtccaggcggggattccgccgcccttcccagcctccctgggagctgggtcgtgggaggaacctggcagcaggcaccaaccaacagacactgcatgctgagacgcaagcagggatgcgggcaagactcttttataaacatgatttctttttagctttaatccagtggattagacacagctgtgttcattctgctggttctttcatttcaaagctgctccaatgcactttcatcctcaa

SEQ ID NO: 221 - DNA, 500 bp, Homo sapiens
catatctccagagcaggacagaaaccagatgcaggcagagatagctaaacatgtcttatctggatagaaaattgagcttaagataataaatatcttggaatatgataaaacccagaggccccttcctggtccatgattaattgaagaaaaaaaaagcctagtaatacgtgaccttatcagagagatttatgttcagttgaaagccaagttattttgagctgagcaaaatgaggattcaaattacaggagcgcagagtaaacttttggcatattagcggacatcttggtaagtttctcaggacagtgtttttcagagatgacaggattaaagagaaaccttttatgacattgtactggaaatggactctccacagtgcccagcacatataggtgctcaataatttttttttttttttttttttttagatggagttttgctcttgtcgcccaggctggagtgcaatggcacgatctcggctcactgcaacctctgcctcctg

SEQ ID NO: 222 - DNA, 500 bp, Homo sapiens
acacaccctgcttgcctccctcaaaagctggacctggccccgcacttctcacaagccccagcctcactgaggtccagctcttgtgttctcccagccccatcagagccctggccaggccccccactggggctgggaggtctcaagagcttggctcaagggccagcaaacagccgtgtcctgcgggggtgaggaggcaagtggatgctctattaccagctcccacggagccaagacaggaaagcagggatccggcactgactcccctcattaaatagcccacgcccaccagacgccggtcagccagggcagccgggcactggaggctgggagctgcttcctgggcctcagggaggacctgggtgtggtccaaggtcagggagggacataaaggagagacagagaagtgggaaccaaccttcctgcagggcccccaaagtgtgatgggttttagataaccctggcgagcatcacaaaggggtctcagcacgggggccttgggc

SEQ ID NO: 223 - DNA, 500 bp, Homo sapiens
ttctgcaaaaagcacacccgcctctctgccccatccatctcccagcacaacgaagccgtcacaaggacatttttcctccaccgtggtacttagggccgtctgtgtggctgacccagagctgccgtgagtaattttaaaaaggcttatcattatcctgacaaaatgctatgtaggtgtgcgtgattcattttttaatagcgcagtcaggaaataaagagaggagccagggcgcaagataacgccagcccccgcgtccctgtgatattaattactcgagacacgtgcatgacatgctgctcatttgttcctcaccgccagctatcttatctccactgacgaccgctgatgagtgcgggcagcctccagacatcctcagacagccttcgatccttcattgtttgttgcattgatggaaaatagcagaggttgcctttcccacggtggcctgcattctaaaaacacagttgtgctctttcgcccttgtttttgctctgcctcct

SEQ ID NO: 224 - DNA, 500 bp, Homo sapiens
attttgttgcttaacaaatattatgcaaaagtagatagagacagtcagctgaaagggtgtttatgttaattccaactagaaacaaacccttaattgtttgcttcagcccactggagtccaaagaatggagtgggaagtcctggcacgagaggctggggaggatgcagggttctggccgcgagccctgcatttctgggctccaagctccccagcaagagggtgaatctgaaggtctgccctggctctgggcgctatgacctaatagctttgtaatatgcctgccagcagctgtactgtacaatttctcatcaatttcagaatgctttaatacaacaatatgaaagctgttaagcaatcccttctatggggagaagaaaggctctgatttgtgtcatactgcatttgttctctggcagcaaattagcatttcatgggctgccacacgcttgggaaatcgactttgggtaggagatgcaaactcagggtgcctaggaaatcac

SEQ ID NO: 225 - DNA, 500 bp, Homo sapiens
aggagccttctccgccctgcgttgaaaccaacatgttcccaggcccagggagcacgaggggacaggccgtgctgagggtgatgctgaggcgggctggtcgggcctcttgtctccgcagtgtgtaacgcaggcctgggcctgctggggccgctggaggcgctgggggaggacgccgtggcctctgtgctggacgtgaatgtagtagggactgtgcggatgctgcaggccttcctgccagacatgaagaggcgcggttcgggacgcgtgttggtgaccgggagcgtgggaggattgatgggtgagtggtagggagtggcctcggcagctccagattctttgtgtgcggagctgagccttgaaggcaggttccgcggggggggtggagtggggtgccgtcagcttggaggggcaccgtctgcccggggatgaccccctggccgctgcgcctcaggaacctcgtctccccacctaagggctgcctttcaatgacgtttattgcg

SEQ ID NO: 226 - DNA, 500 bp, Homo sapiens
cagtatgtgacacacctggcacgcggatcaggaaacaactgttttacttcatttctgtcatcaccttccaacagatttctttcacattccaatttggataggaggacttgactttctctccataagttctccattaacagtttcacagcagaaggcgccattggtccgcttcctctcgcagcaattaattacacagagcggcgtgttttgacgcggaccacagcaaacgcgtcaggtcacgggcatttacgcgtatctgagagcaacgtctttatcatcagcacggtgcgttccctgcaaaggtaatgaattgtcatagttcctcagacaggcaatgacgaacaccgtgtcaagtcagcagcacaaattaccaacttcaactcccttcagtcacttttattaatatgcattttatttgagggagttttttttaaggagttgtgtcactttatgcgttcggcagatgaaaggcactttggctttctgtgttagcagcggag

SEQ ID NO: 227 - DNA, 500 bp, Homo sapiens
gggatgtatgcaggcagccttctggcacagacgaaggaggttcaagtcctctccatggacgtgagctccaaagcggaagtcacaggtccaccataggaccactgttgaggttaggcatggccggaaaggagctcccttccccactatcctcctgccttcttcagcatgggcctcctcccaaggcttggccactcccagcatccagcacccccacctctcagctgggttaggaggcaggcggaggcttttcgcgggggctgtgcctggtgggcggttttcccagagcagggagcaaacaggactgagttggcgccagcttcctcggatgtagatattgctggctggatgaccagccacagccagctagcttgagtccaaggcctcctcaggcactgtgtttctgctctgtgggctgcagccccagtggggtggcatgtcacagaggaaggccagagggccaccagccatgccaggggtggggcatagccagactcaggcca

SEQ ID NO: 228 - DNA, 500 bp, Homo sapiens
ttacaagtcatttttaaaaatccttttcaatcaaactgatcatgtatcttggtaaaagcccttccgcatgggctcggggatttcagagtgctgggtcctggccccatgagtaagggatcacccgctcatctttcagcccatccaagcatcttggaggtttagaatctgtcaggcctggcattccttcgctcttcttatcactctctaccccttcaaaaaggcaattgattagtttcagcttttccaaaccgagatccgatatgtttttcaggatcaaacgtctttgagaagtccagagagcaatgtgggaagtggggaatgtgaagaaggaaaacaggagggggatggtgaaattcatctctcaccctaactctccaaaggaacctaggggatgcgcattttgggcaggagatggaattgtgacttctggaagatgcacttaacaacttgagatgtgtcttccctttctgaaagcaaatgtttaaagaagaaaatagata

SEQ ID NO: 229 - DNA, 500 bp, Homo sapiens
caaaataaacttgaaattcactatgttagcctgtatgcaattttgggtgatgatgggctattggtcgttttgttgttttaaaaaaagaagttagcctttattcatccgagtgccacagtcactttgtgcagtaagttaggtggtgaggtaagcttgctaattaatgggcattttaaaggactttacccagcagcagacaaaattaagccctggaaagaatttagcccagtagccagtcatatgccatgtcgtatagcatacccagccaatggggagagcgaggtgtggctgtggaaaaagacagggttaagcaatttttttaaagcactacatatttattgatagaatatctctccaggcagtattcacatgctttaaactgaagctcgtagcttggcagtgcagtttaagcaaataaactcaggctgttgaacacaatgattaacaggaagcaggggaggggacatagttactagactctggccgggacaagaggctga

SEQ ID NO: 230 - DNA, 500 bp, Homo sapiens
agcccaggccacaaagagcaatttcagtgaattgtgcaaagatatattttcaaaatacagatcacaagaaagcacatcccaagtgtgaaccgcagtcgtccgcccagtgggccctcaccggttgctcccctgcctgcaggctccgtgcttggtatctcagaaaaccttcccgaggaaaaagcccataagggacaagtcccggcccaacttaaaatcacatcagactgctttccagtagaggagcaaggtcgagattccggcccagggaaatcaccgcaagccctgcgcattgttcagaccccttccccctttgccacttcccgccccccaccccgacctccgaccgattcgcagcaccccacccccagtcggggccatccatccacctgattaactcgccggcagcaactcccagcgtagaaagtagggcaaatgaacacacacagtcggtaaagcaggaagccacagacctggccaatgcacccaccctgttaccaacc

SEQ ID NO: 231 - DNA, 500 bp, Homo sapiens
ctaggagcaggaggccctagggctgaagggaagggagaggtgggggttctccagtgctccgcaggcgcgtcctgcccaccccatctccccgcagtgggtttctcctctttctcttctgtgactggggtggcccctgtctgcattacccacagagagtcagtcgtctttccaggaccggaggtctctgtgtgtctcatccagagagagacagagtctgccttgaatcagaggtcatgtggccgtccccgccgggccgaacaggttgcaggagcccttggctttccttcacagagagggcagacaggaatctgcacgcgctaagggaagtttgggagctgcgacgcgtctatctgagcaacgagttgagccttctgataattgggaagtacccttgctctcagttctggcgatgtgaaggctcccccacccgacccaggccgggctgacagtggccagtcctgcgggctgagggcggagcggtcagcggtttcctctcggcg

SEQ ID NO: 232 - DNA, 500 bp, Homo sapiens
catcatcagcggactgtaccagggtgccggtggtcccgggcctgggggcttcggggctcagggtcccaagggagggtctgggtcaggccccaccattgaggaggtagattaggggcctttccaagattgctgtttttgttttggagcttcaagactttgcatttcctagtatttctgtttgtcagttctcaatttcctgtgtttgcaatgttgaaattttttggtgaagtactgaacttgctttttttccggtttctacatgcagagatgaatttatactgccatcttacgactatttcttctttttaatacacttaactcaggccattttttaagttggttacttcaaagtaaataaactttaaaattcaagtgatgccttttattcctttatttgggggtcagtagggtctgcataggttgtttttcccatagcgtctaaaatggaatggcatttttgcttccagtaagggcagattttgcagaggtgtgactattgt

SEQ ID NO: 233 - DNA, 500 bp, Homo sapiens
cacggtgacctctgcaggtcgacacgttttccttcatggccgcacgaaggccccttacaggtgctcacaaggactccaggtgcgagatgtgctcaacccaggactgaaaacgaatctgccggtccacagcgacgccctctgatgccgcagagaaaggcccgggcctgccagacgtgtgtcacaactcaggccccgccaggaggaaagctaccgccagcactcccaggccgtgggaacaagcaaacgcaccggctggggcaggaaacacttgcttctggttgtgactgcaaacagcctaaaagaacggactcccgtaaccacgctcctgtgtgcgcacatccaggctcgccctccattgacaaaaaggacgtccctcatgctggatgtgcagtgtcttcatccaagatcaggacgggcgtctgtccatcagttcttacaggctatttgcacagacccacggctgttcttgggtcaatctgcgctaaactctgcccaaccca

SEQ ID NO: 234 - DNA, 500 bp, Homo sapiens
atgagcatttcttttaagttattgaaaagttattttaagtaaatgaagtcggtatttgccctctttattcgagcacgagagcagagagagagctgctgctctctggggaacgctctcagaatcccgttctaaccccgggaaaactcagcagacagaaatcgcccgccccaagcagcctggggcctgggcggccaacagcacccacccagtttacgcttgattcgaggaaccttcactcccgaggggcctcgccgaaaagcagctccttcgctcccgaagccgctcccaatcggccaactgacaacccttccctcgccccagatttgctaggatggtctgggaccgccgggcggcccctctacctgccccttcagctttagtcccgagcctctcggggtttcaatttgggctgctcggtggcgcccgaacgcccctcagcggcggtggagcgtggactccggcgcctggcggggtaaggcccgcggcaagggcgctgcatc

SEQ ID NO: 235 - DNA, 500 bp, Homo sapiens
caaccacctgtacgaggagggggtggtggggaggcccgggaggcgaatccaggagcctttctcccagaacgggggcccgagatacggatttgagagatgctttcacaaagcctcaccaagtcccacggggccaatttcttctccgggggccgaagtgcagagtgagtaaccaagatgtaaacagttgcgtgatgggtttgggggagggggcagcgcatttattgtgtgtgcggaagggagaaagctgcacgtgatttcaattttgaagcacaaagaaataacatgcaatgcagaaaataggtttatgaatgtaattgagaggaaagaaaacaattaacacggtgcaaggttgcacactccattccccacccctggccttctcttctaccccaattttgagaaattcggatcatgtgaatagagtggctttaggcagttggatccggctgacaagggaacccctgatggggatctcagtgatggctggataatggtgtcta

SEQ ID NO: 236 - DNA, 500 bp, Homo sapiens
tttgggaaacagtaagaaacattttattcataatttcagttttaattgcataaaatatttgtttctcaatcattatcagtctcacattttcaatattttttaaaggctatcaaagagagaaacataacggcggtagagaggaagtcaccaaggttgccactcagaagcaccgacagtcaccgctcaactggacctccagtcatttcggagaggtgactgggagcgccgagggctgggggccggaggagccgctcccatactcctgggctttcggagagggtaagttgcagcgctgcccacaaaatccggggcgtcatctcagtctgcggactcagagtttaggacctgagaatatgtaggataaattcaggataaaatccaaggagagcattttgttatcttcaaatgatgatgcacttacaaagctataaagctagagacagttcctagtgaggtgttaaaaagttttactctttcattggtaaaacgttgtatttgct

SEQ ID NO: 237 - DNA, 500 bp, Homo sapiens
ctcacctgtgcatttttacctttgactccagagcatatgaaacagtacagggttgagctgtcataaagcatgactttgtatctgacctcgcaataattattggaacacactgattagcaaagaaaagcaaactgttggcaatgaagaagtttctaattcctggaacatgctcctttgatatggtgatgcattttctgaaacatgccttacacacctccttactagcttttgaaatctgcattgcacaggcgaatatcatgggcatggggtttggcaacccgggggttaagcaatgtcaggctgacgctattcgtgtaaccagcacaggtgcagggttttagtgctgtagcagccaatcaggggcagacagtgtgggttgagtcatattttccgtttacagaaccaatgggtattttacataacgacagggaggtcacgctgaggacatactgaagttagcacatgtatactacactccagggaacaggaaggcagaaaaa

SEQ ID NO: 238 - DNA, 500 bp, Homo sapiens
ggggtcaggatccatgactttttaacattgatattcatctctctttttagaacagaaatgggtgcccagctggtcaacatacatttgttaccttgctttaaaatgccttgagagtggaaccaccggtgcaggcttggctggtcaagaatcatgttctagaaattatttccagtgctgagcacagtccctgagatttaaaaacgcttatgggatgaatggaaaatagcagggcctcttaccggcctgcaacgcctttagaggcacggatgccacgtgcacagacccagctccgggaagcacaagcctggtggtgtgcgggaagcggcgaggtgcgcgggaagcggcgaggtgtgcgggaagcggcgaggaccggctttaaagtcacagcagtttcctgaaagatgagggggaggaggacagtgacgctcacagcacagccacttgtcaacttggacatgacacacacaaagcccagagctcggacggcaccgcgaggaggc

SEQ ID NO: 239 - DNA, 500 bp, Homo sapiens
tctcttggctgtcaaacaggaagcctttaaaagttggccagagagttatggaattacctgtggaaacatattgtgagggtcaggccaagggccgatttgtcaggcggccagtgtcggaatccacacatccacaagcagcatttgttttcttaacacttttttttttttttcccccttccaggatatgtagcggcagaggccaaagtctataaatttctgactctgcgccctactcattgtccgagtttccgcgtttttcatgaacgctctcggccgccgggaattctctttgatgggatttcaggtttcagcagcaagtcctgtttacttttctcgattctagacccaaaggaaaatgatactttgctaattccctcctcggaaagccctcgtctcctggttcttgttccttgggattaaaagttgtgacttcaactttttcttccttggctctaagatgggaaaactgagaaaacagcgatggtcaaaactgcgctgat

SEQ ID NO: 240 - DNA, 500 bp, Homo sapiens
aaaaatgactaatgacttatcacaccgatgttatttttgaaccttcctccttgcatccaacctttcagggaggaacaagtaaaagcagtttatgcctcaactgtcccggttccccgtgaagaaggagaaaagtgaaaccatatgcttagcaaagagaggaaggcaagccagagaggcaggctggaggagaaccagcatggggcacggccgtcctgcagcaaccagccggcgggcaggggtgcctagccacgccgcccccaccgccagacagcagcgggccggatgacagatgctcctctccccatcccacaggcgacatttagtgccctccgtgccacgagataccgggatggctgcaggggcaccacaattagatcggcaggatgtgaaaagagtcaacttttttgtttaatgccatcaatttgcgatggaggagacaggtattagctcggggacctccgcggtccctgctagctattagttccctgcacagctgcacc

SEQ ID NO: 241 - DNA, 500 bp, Homo sapiens
ctggaattggatgtctcccagaggcaggcacagcagcttctaactcgagagagagagacacctcatcatccgtggggctcaggcctcaggtggggattggccgcctggccagagggtagctgagcgtggttccagatggctgcctgatgcccagcgttgggggcaggagggtggctgagcgtggttccggacggctgcccgatgcccggcattggacccggcaggagggtggctgagcgtcgttctggacggctgcccgatgcccagcattgggggcaggagggtggctgagcgtggttctggacggctgcccgatgcccagcgttggaaccggcaggagggtggctgagcgtggtttcggacggctgcccgatgcccggcgttggacccggcaggagggtggctgagcgtggtttcggacggctgcctgatgcccagcgttggacccggcaggagggtggctgagcatggttccagatggctgcccaatgcccggcgtt

SEQ ID NO: 242 - DNA, 500 bp, Homo sapiens
ttgtgtctcaagattcaaagcaaggaggtaaaagggaaataatgagaaaggagttattaaaaaatatgtcacacacttggggagtcagagtttgaaagctgaatgctctctgcaaagtttcctcgttaagtgttcccattttgccggtgaggaaacacgcccagagaagtaaagaaacctgcacgggatcgcacggcaattagtgtgggggcagagccagagcttccgtcatccatgcgtgatcctgcccgatcatttggaaaatcggtttttagccgtgagcccgactgcataactgggcggaggtgtgcgtgtgttcatgcttcacacgtgggagtggaaagtgagcatgtgttcaggctgcaaaatgagggcaagaggggcctggattccccttcacaaagcagactgacctggtcagccactccgataaccagctggaacttcagcacaaaccatgttcagcttttatcaccaaaataagcaaaagacttcagtct

SEQ ID NO: 243 - DNA, 500 bp, Homo sapiens
cttccaaggctggctctgcaccaaggaaggctgaaccgagagaaccttggactagaggtcgtggtactcagcgctcccttcactgaccatttaaatgtaaagcaatgtttgtcctcgctgtcagtcgcaacacttgattactgtagatgtcagagcattaagaattcctgccgatggacaggagccctttcgctcgcgagcccgtgcgtgcagcagccagagcctgtgaacttcgtggaatgctgtcgacgtgcggatcatcatctttacgttgctattaaaacagctcctggcactacaaagtagctgcgttggagccaacaggaatccataaatcagcagcaggttaaagattgttgaacttctctgtgagggatctggaaaatacatcactgacttccaccagccacagagctgcagggtgggagccgagcgggttcctctgagcagcacaagcgtcctgcgcttcgacacacaatgagcctcagtacaggggcgtg

SEQ ID NO: 244 - DNA, 500 bp, Homo sapiens
aagcctaaacccttctggggaaccaaggcacttcccattgtattacattctctatagcagagctctctctcgacatgtgggcaaagcgcttcttgactcaaattctcgggatccatatccaagctggcatgggaacaagacttactgaggtcgtaggtctgtgtgagcatatcccgctcgaacacaatgtccactggaggcactgtcttggagatgacctcctcgtcctcgtcatcatcatggtcattccgtttaaattccttcagcagcttgaggcaccgaaccatgacgtcggtccctggcaacacaagcacgggtttgccagcaatgagtgaaagcagtgctgcgtgggggaggtgaggggttctgaaatatcacagcacatgtcagcagagacagagatccccacaaaggtcacacatatcaccgtgtctggacttttaaaaatggctcatcttgggccacaagacctgaaaatgtattccataaagctgcttttt

SEQ ID NO: 245 - DNA, 500 bp, Homo sapiens
gaaaactagaaaaacaaggacaaaaccacgaaaaatcagcatgctcagggtactgcagaatttcagaaaggtgttccaaggtgggaatgccgcaggagtgtgagcctctcaccacagcccttcagctcctgcttggacaggcacaacctggcagggaaaggcggtgtctgcagcccgcaggaggagacgctctgcggggagggcgatcgcccagaagtgcccaggagttggcttcggagtcggcacagtcgtctctcctccctgaccatgaggaggggggcagaggtagcccaccggtgacattttagccagggttaatggccatagcgagaccagcgagggtataaatggttcaggaaaaaggtaatcattcaactgtgaaattacaaggaatctggggggaaaaaagaaacagaaacttattttagaataaatagctccgttcagcttaaaaatgaattgctcatttatcttaaaatccttgatcatcaccagattcc

SEQ ID NO: 246 - DNA, 500 bp, Homo sapiens
gggggcacgcatccgcgggaatgaaaaataacagaggagaccatattttggggtggttttgtctgatccggaattagaccctccgtgtttttgcaaagcagaagaccttaaaaaagagccagcctgaggtaaacttggaatgaccgtgatggatggggtggtgggcggcaggtttcagccgggcagcacctctcgcttgagtctgctcacagcccagacctgcccaaggctgactgttttcccatctgccggagacacgggcgtctagctcgtacctcgctgtgttcaccattgattaagattcagcattttccagttttgcccagagcgctgtcagggaggtttggtcttgtctgaaatgtctgtgcaggaagcacgtgctgagggagccaggggctgcttgtttgggcctcagtttgctgattgtccttgagcgaaaatcattctgtgtttgcactgaagcaatgccgtgtcttgtagagccgcaccccggaatggta

SEQ ID NO: 247 - DNA, 500 bp, Homo sapiens
ctccggctgaagcctcaacagggagctgatggagcaaattggcaagctggtcccatcagggccacagctggggcctgggacctggctgcctcccctccgtccgtcggtctgtctgtgtgcagggtcgggtctccaggggaccctctgtcggctctcaagctccctcccatctcggccccagccccccctcaccgcccgctgtcaggatgagcgatggccgtgcccctccccggccctcggccccaggcccggttcccgctcattagccactgacactgtttgctttcccgccatggacgcccaccccgtcacaggccatttctcccggcgccccccacccctgaggacctgcccaggggtccagggtgccgggtcgaggggactgccgggtgccaggcaggacctgcattatgctcccggagcaatggccacatggagtgccggccccaccctcacctgcaccccaagagacggggagccacgggccaccctgagtctcc

SEQ ID NO: 248 - DNA, 500 bp, Homo sapiens
atcgtcccctcgtgacagggaagtgggaagagatgttctgttttgctcacagcagaagccatcatttacacaccttctcatggcacctgcctgggaattggaaacgatttcaggagccttaattaatgaagcgtcacaacatgcctgcaggctacgtgagagttattatcctggttttgccaggagacagccggatgcggaggagtgcaactcggatttgaaggtcaccgagcgcgttaatgaaatccccggaagtgtgtctgccaacaatccttttattttggctttacctgctgttcgcctgatgcctgtaaacctttcccgagtgttgattttcggaagggtgctttgcagggtggagttggggtggatgaaatgcggcccccgggtttctgactccctttcgtggtgcaggtgggctgagacccttgatgaccgagaggttagaaatcaaggacataaattcagcactcttgttgaatagatatgacccttgttcc

SEQ ID NO: 249 - DNA, 500 bp, Homo sapiens
tgagccagcagagcgtggcccgggccggcaggtgcactcccagaaggtcgttagcaaccctaactctttccccgacaataatattgacttcacattagataaacatgaatcttctaaacaacaggtgaacacgcaggagccggcctccccgcgcgatgtgcgggagaaggcggtgggacacagtccatagagtttaatttcagctgtaattacctttcctggtgaagtgagccctgtaacaaatggagccgccgccgcaacaaggagcgctgggaggagaataaaagaggtcgcccccctttgcaggaccaatttctgttttgaacaaaacccattattaacaaattagggccattagaggaatctctttacgccttttctttattgaaaaggaattcaaaacaggagagaggcaggcgggtgtgttgtgagaacattaaagtgaattccagaaatgcactgaaccagcattggagtcaggggttagtgtgatgagaaaa

SEQ ID NO: 250 - DNA, 500 bp, Homo sapiens
aataaacaacttcatttttagataaagatgaaacttccaactggctagaatcatatttcagaattagttacttatgatttcatttttagtagctcatggaatatatttatcttgttgacttaagcacatacatgaaatattctaggtttgggaggacgaggagaattcctattgtttagaaatgcagatgaatttgtttccacatcattttggcaacccatgaggcagcttacaccaaatttttcttctcgcttacaggccaaagagttttattgtgcatggcctgtcaagcatagagttgcttacatgggcgttcttaaatgtcctagaaattcctcaccctttgtccttcccaacatccataaattcctttttggaatgtgtcaggaagagagaggagccaggaaacagccttaagtgtgtatttttttttttttttttttcctgaggacatctgatctccatagttgagtgagtccggtgcaacctgtgtcataaaa

SEQ ID NO: 251 - DNA, 500 bp, Homo sapiens
acatccagggaagcgtctcaaactggcaatccactaataagtcctctggcaccgagcagtgaacacagcggcaggagggggcttcactctgggaggcgagacctggtttcactctttccctcctgtccacgcggaagcccatggacagcggaatggcctaattgatcccctgccagccaagtcctggttccaagaggctgcagcctgcctgtttggagctggacggaagggcctgctctgcccgccccacgcgagctccgcggaaggcacctgtttctgaagcctctcactgcacgtgctccgctggagcggggctctcattaagagaggcaggctgcgtcacggcagggcagtgctaattggatgtggttgaaggctcaggaggggaagcagagacagttactgacctgtacccagaactgatgacgacacagtaatgcgatcgcccagacactgcggtgctgcctctcctcactcgaccccctcttctctgtaatgta

SEQ ID NO: 252 - DNA, 500 bp, Homo sapiens
cttttcgctcaccgaatctcattacctttctttaatagacatggttttgctgggtgagtcaagaaggccctcccctgtcggcgttttgatctctccagcagcaaacatcgcacatggattcttgcagagcttctcctgtggctgttccgaagaatcctggggcttccaggacacgggggctgtggtttgagcaatagttttcccagcagctgtccccgtctgctcggaagtgggctccccgaactctgccgctgggaaggaaaagagcaacatcagcactgaactcctcaggcaaacattcttccagcgattcgccctcaacagtgcagctctcagggttcaatccgtgggcacacggcgggtgacccaatccactgggatttatgcaaatctgcagcacgctacactctgtgagaaaaccaaacttcctggagggttacccacacagcaaaatgcttcgtggcaattggtttctctcctgtgtgcgagacacaggaagt

SEQ ID NO: 253 - DNA, 500 bp, Homo sapiens
cctctgtccccaaacagggccttccttcctgagctctctgctatgcaaggaattctgcgtgcagttaaaaaaaaaaaaaaaaaaaaaaaacctggatttgctgccttctggtctgaccaagttggaatgcgcagcgtgaagaaatgctcgttgcctaggcaggaacagccatccacaggaaaacagacctcagtaaataatgtcctcgaccttcccccaaaagcccagaggctgcctcctgtgagtaaccgatgaaacccgaggcgctcctgtagctcctgggctgatccctctccaggagatgacttggatgagaaggaaggtgctatgggcttctcttttctttttttggtttttttttttttggttttttttttgtttttttgagacagagtttcgcacttgttgcccagactggagtgcagtggcgcagtcacggctcactgcaacctctgcctcccgagttcaagcagttctcctgtctcaacctcccgagtagc

SEQ ID NO: 254 - DNA, 500 bp, Homo sapiens
cgcacaggccgggagcctcgctcaaacccgccctgacctctggctgtcctggcttctcccctcccaaggcaggactcctgtctccactgaggttctttcctgcacttctaaaccccgtatcccaccccttcagggctcaggcctccactagaaggtgactcatggccagggaatgccagtgagagccgatgagtggctgcatctggctgtagagtagccagtgcctagtgtggggtagtcagcagtgctcggaggacaattcacttgagctcctgggcccctttccctggaaataggtgtatttttgacagggtcttgttgaaacaacagttcagagcacaggcatgactccaggagtagggatttatggcatgtgggacaggctggttgtgtgcccagcccagcatgagcccctcaggcagcgccatgcacatgggccactgagaagcaggtaggatgtagactgtgtagtctgggtctggaggtctgaatgcctcttg

SEQ ID NO: 255 - DNA, 500 bp, Homo sapiens
cagacccccaaattcatcaagcactgcattcttggcaaagtttgtacacattgtctgggtgctgattgtgaaaacattgcctaaaccaaagttttgtatgtgatttcttttaaagtttctcttatttcctgttctgaggtttatacacaatagacccgaatagagtttgaataattgaagggtttatgaaatccagaggatatcaccagctgctgatttgcacataccaagaacatgaacattttccaacggagaatttccctagcttaataagaaaaagtccaagagccggtcacagcattaacatttagtgggagtgcagtgagaattgggtttaacttctggcatttctgggcttgtggcttgtggttgattttttatttactttgcaaaagtttctgataggcggagcatctagtttcaacttccttttgcagcaagttctttcctgcactaatcacaattcttggaagaggagaactggacgttgtgaacagagt

SEQ ID NO: 256 - DNA, 500 bp, Homo sapiens
cacgtgtgggtgtgagcacacacacaaacacacacaaagacacacagagggaaaaaagaaaacgaaagtaacaaagtgcccagaacgttatcatcagcatacaagatgacaccattatgcttttgctaagttaccaggccacaattttgtcttcaaatctgctctaatcagtttcccagtgattttgtattacccctcaacaaatatattagggaggaaactgaggagaagaagccagtgtcccgcaagcggcttcgggattaacactgcatttgttctgagagagaaacttgaagaggaaaagcaaatgagaatagagaagaaactgtagtacaaaggaattaaaacaaagaaaatatgaagagaataagaaatacaggtttaatcatttctgggcagaaggaaaggacagataacaaaattgctcttttcatttttggacagaaaaaaaagacagaaaattcatgaggaaatgaatatattctacctttgttgttaac

SEQ ID NO: 257 - DNA, 500 bp, Homo sapiens
ttacaataccccagtctctactaggggctttataaccacactcactggaacaaatgtgtattcagagacccgcttcacaacaccgttcaaataacacatcagtgaggccttcagcaagaaaaacacttcgctgagcgagttctgcttatgcaaacaattgttcatcaactgcattaaaagagacagacattttcttccattacacttgatgaggctggccaaaaaggaaactgagctgttttcttgtcacggtgagcaatgggaagcttgagataaaccactggacagaaagaaaacactacaccatttcctttacaccctcaaaagaaccacattttcctttccttttcactcagtgtaaactatatgcatgtgtcaaacagtcttgaaagatctggcattctgcagcaggatttagtaaccagctttttaagctcgtgctgttctgtgacaagctgcttgtggagatgtgaagggaaattgcaaggtcttgtagaaat

SEQ ID NO: 258 - DNA, 500 bp, Homo sapiens
tgcatttcccacattctcttccaggggttggaccctttccatcttcacaatctgggtagagggaagatgaagatatggaaaaggggaacgtgcgataaaactgaagttttccccagaaagaaggaggtaaagacaaaacaaagcctatcaatcagaaaataggcaaaggtcccagggccagagataaaaggcgattgaaagagcaaagcggactctctcagttttaacgctgcaacttttgcaggcaggcgggggaacttctttgtgactaatctgaatttcccctttactttctttctttttttttttcctctgggctaacagggagttgtttttgtgacattccagttctgatttgagtgactgtgaaatgacagtcataaaagtatgctattttcttaacttattgcaccagtaacaaattgtgggtcacttggtaaagataaaaatcatcatccgttaatgtagcagctcatatatcccttccccaaggtgtctta

SEQ ID NO: 259 - DNA, 500 bp, Homo sapiens
ggaaatgtactactttggagtggggagtatggcaaaggagagcaaaacaatagttcagatcaagtaatcttagagccaggaggcagccaggacttccgcctgctgggccattgttgcaggaccacagcttcgaggttgcgcaacacctttagtaaacacttcctgaatcagagacaagaatgaaccagggagtttcattctgtctcactggagaggaggcagggacagacccagcagcacccacctgagcgagaagagcagacaccgtgctcctggaatcacccagcatgttgcaaggtctcctgccagtcagtctcctcctctctgttgcaggtacatatttagctctttttcaggttctattgaatgcattagcgaacttttcatagtctcctaatagttttattgtataaactattttgacttttttctttttcttttttctcaatcaatcttactaaccagttgggctggttttaacctgttgtttgggggctgcg

SEQ ID NO: 260 - DNA, 500 bp, Homo sapiens
tcctctcgaatcttggcctggctgcatttcccacattctcttccaggggttggaccctttccatcttcacaatctgggtagagggaagatgaagatatggaaaaggggaacgtgcgataaaactgaagttttccccagaaagaaggaggtaaagacaaaacaaagcctatcaatcagaaaataggcaaaggtcccagggccagagataaaaggcgattgaaagagcaaagcggactctctcagttttaacgctgcaacttttgcaggcaggcgggggaacttctttgtgactaatctgaatttcccctttactttctttctttttttttttcctctgggctaacagggagttgtttttgtgacattccagttctgatttgagtgactgtgaaatgacagtcataaaagtatgctattttcttaacttattgcaccagtaacaaattgtgggtcacttggtaaagataaaaatcatcatccgttaatgtagcagctcatat

SEQ ID NO: 261 - DNA, 500 bp, Homo sapiens
attattattacttagtcatttgggcatagatttgtatatcctgttgccaaggtgaaggtaataattgaatctatccaaaatctgagtgatagcgtagtaagaaatgactccatctgacagaagagccaggaggcaagtgatggatactattgtccaaacgtgaccctccattaacaccacctatcagcatctggatcctgtcactgtttcccatcccagagccaagagggctgcctggcatattccaagcgtgcttcccttccaggggcttcgatgctgcgctcaaccccgcgtcaactaaatgggtgggaagcctgacctaaaccctgctctctctatctccactctccttattacccctctccaggcccattgtttggtaggtgctggcaatttgctccttatcgcgcctgtgtttatgatagctttttattaataacaaagagagaaatggtattaatattaattaacacaataaaatgaaactgttttgggaatcc

SEQ ID NO: 262 - DNA, 500 bp, Homo sapiens
taggtccgagccttaatgtaggagctaaagccagagaatcagggctccggccaacccgcctctgctctgtggtgaggcgggagatctgggtggcccaacagggcaatcccacccagaaaaggtattttctgtgccactacaactggcttaggaaactgaagcccaatagcagcggctccatttccagcctgcttttaagacatttccttcattttggagcatttggtgagggggccagtgaaaccggctcgtaaaatagggcttttatgggaagaaatagggtcgggttgctagcatcctgggacaatctctccacagaggaagctgggtggggcctgtgggggcaaaggagctgtccttctccctccccactacctcctccataggtcccaggaacctctgagcagcgtccaccagcttaggtggcctgacttggggactcaggcttggggcaatggccaagtctgagaagaggtggaagccaggaactagcagtccca

SEQ ID NO: 263 - DNA, 500 bp, Homo sapiens
aaagaaaagaaaagaaaggtcaggaagcccagcctctgccttagccactctgagtttaaagccactttccccttaaaagtggggtttctctgtgactttgtttgatttttttccccttcctttcttatattttttttcttcctttctttctaaaagttaagcccaacaggtccaggatttgtgcacagtgagtggaaaaaatgtgttaaacgtcggtttgacgccccaccggagcttccaaatatccagcggctgggattcttctacttaatttaatctttattggacagggcggctcctatgctcctattcactaggaaacccggggaaacatatccgttggggttcagaattgagggtgggaaggagaggagttaaagagggattaatcctcccccacccaacttcaaactttagaactgcaatcgcctgcagcctgggggggtgtcccccaagtcccagccctgacagcccagggtctctgcgatctggagccagag

SEQ ID NO: 264 - DNA, 500 bp, Homo sapiens
attcttgattaatgaaatgcagatcttaactacccctttcctccaagtcataaaggaaatcccttgtgaaagaaagcgattcccaaaacccagactgagagagtaaaccttaggcacccagaagttcaataagcgctgtcccttccaccccaaatctccacaactcccctagccccgacagaggaaaacctcacgtccttctctgcacctgattccctttgcttgctcctgaactccggaaggctagaacgaatttatccaaagatggaagaaagctcagcacctggaagctcccccaaagggtactggccaaagatatgcaaacattatgtagatatttcagttgcgggtttagatagtgggagatggatcctagtctagaatattcgagtcttcaagtcactattattcaacaggtcttcgctatgctgcacacttcagatgccaaactgcattagctaacgtgagttgtcccccgttttcgtaggagggtcgtgttg

SEQ ID NO: 265 - DNA, 500 bp, Homo sapiens
gggggagggctgagggcctcttcttgtctggggcggaggggaggccacctccagcaggaacgcagagcgggtttccagagcacaggtagcactgatcagctagaactgaaaagggcattgctgagtagaagcacctcttccctcctaccttgcggtttccccatgacccgccctaaccctcataaaaggatctctgctgcaagagcctcccaacccagggccttccctgccacccccggctcacaccaccgcccaccgcaggcacacttagtcctgtccacgccagacactcaatttcctgtccctggcttgtggaagggcctagccgcctttccatccctggtaaccggtttctctctgtcatctcttctttctcagtccccgacttcctcacctaaattccctccaggcccagtccttagaagctgtaaataaaatgtgccggaaagaaatcaggaccatcgtgggggattcctgagccttccttctgtttacttcct

SEQ ID NO: 266 - DNA, 500 bp, Homo sapiens
gtaattaaggttgtgaactgcaccacgatgctaaaaaaaacaaattctctgcagctgttttactgactgagaaattacccctgtcggccgaagttttattcttctgatttggtagaggaaatagtttaaaaatgatctcacagcgtgatttatgtaaacggcgcttctttctttggatgagacaattgagatagagtctgaaaccctggcaagccacagcttcctgcagtgtcctgttgccatgggttacgaagggagcgagagggaacttcatcggaaatgcctttaaacttttctcacacgcacaagctgcggtgttgaatggtgtgtcttagacccgggtgcctagtgtggctcggtgccttacaatgaatttggggaaagagttgtcaaacgaaacccatgtttctaatgaccagcaggtaagtagttccggctttttcttttcatttaatcagtggtaggaaagcgtggcaccctggctatcctgttttagcgag

SEQ ID NO: 267 - DNA, 500 bp, Homo sapiens
gaagggggagacaggcctctggtcctggggcaggcagtgagaggtacacgccccagaagggctgatgatgccgggcaggcggagcaggaaaggagggtgccaggaaggaaatgggttctttgtttcgctgttgcatctagattttgttttctgtctctggattgtaaaaagctgctctggcggcccgcccgccccggcggggactggggatgcacgtacacggagaagtcctggctgccaggccagcagcgctgctctgctccggagaaagcccgggctggcccgggccgcaggctcccggtggcttcaagtgatgagattttttttcttttctttttttttttttttgtcttttttttttcttttccatttcgttgaaatatttacagcaatggggaaggaggaggagagaggaaggagtaagagggccccctagggaaagatccaagcccaggacccactccccagggagatccagacccaaaatctgctccccagat

SEQ ID NO: 268 - DNA, 500 bp, Homo sapiens
cttggatggggggcactccaggctctccagcctcctcggctcagcctgggcccctccccatccaacatccactccagtcctcattcaacttcctcttcctgcgaaagaggggcgctgccccgtgacctacacagactgagacacgatcgccatgaatggagacctctggaaaagctcaggagccgaggcccacggggcccagcagaggcctgaggggagaccctgggcgggggctgaatcactgcctcccgacagtcccccaatgcccgggctttggaggggagccgggagcttcccatctccttttgcaggggagggttgtcagtctggcgggatgtgcactgggggcactccaacctctgctagctaaccccacatcaccacccacccccgcctcccagcaccaccaccaccacacacacaaaaaaattggatacattttgaataaagcgattcggttccttatccggggactgggttgctccgtgtgattggccgga

SEQ ID NO: 269 - DNA, 500 bp, Homo sapiens
atgtttgtctggcacacagtaggtatgaggtaagtgtgtgccgagtaaagtacacgtgtggatacacaggtcccagtgcacgtgtgtgcatgtccacaggaacgcccccagggtggacaaaggtgcctaggtatgtttactcgtgtgctgtgagcccaggcatgaacttagagctccctggtcctggccagaccaggctgggctccttgctgggcacacggaagcctctgccttgtgttggtgcccgtgcgggatgctgccaggagtgtgttggtggcgtgtgtgtgcgtgaacgtgtgtgtgtgtgcgcgtgtgtgtgtaggaagaggcgttcgctctcttagaccttgcttctttctgtggtttggtttctatagagacacttcctgtggcagagaaaagaggtagtgagcggtgtttcaggatgtgagggcccgcaggagccgagtcaggctctctccactgcctgcccgccaccgtgcaagctctggccggcgctg

SEQ ID NO: 270 - DNA, 500 bp, Homo sapiens
tctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttct

SEQ ID NO: 271 - DNA, 500 bp, Homo sapiens
tcagaagcagaagcaatttctgaagagcgaggcccgggactgagttggcgagactcccagttcgagtgagcgaagccagggtggagggctccggaccgagattcctgaaagcctccctgacaccggatcctgagcgcaggacgggcccagccacttgggggcgccgctggccccaaagtaccgggagcttaccctccgctgaccaggattcaccctggctggcagagactaccctacgctccgctcacccggccaccccgccccgctctgcgctgaccctccgttagaggctgactctccaaactaggacgatcttgctcctatgcgggacgacccagcgctaaaaagggatgaccctataccaccgggggtgaccctgctttgagtgggtctgaccctgtgctaacagagatgaccttaaactgacagaggcagatcctgtgctaaccgggatgtgcttgcgctaccaagattggctttgtgcgctccctcttaaggct

SEQ ID NO: 272 - DNA, 500 bp, Homo sapiens
gccacctggctggccggcggctcagcgcggccgcgcggcttctgggcacggtcccactcccggcgacccgacctctggggacccggccgggccagggggacaggcttgttagtgcagcactgaggcccggggacccctcgaggacgcccgcacctcctgccctcccgtgccctccctggtcgctcgaaggctctgcgccgccctcgccctcggatcccctggagggtgcgcagccgggcgtcaccagatcgggtccctctcatgccccgtgaacgcaactattctccggggcaactggctccactgcccagccaaggtctcccagtccggatcccgctggaccccagccaggggaggtcttttctgtgcttttctttccttttttgttctcctgtttgtcctctcacccagcccattcttctcctgtgttaacttccaggttccccttattattatagtgccgccccccggggctccgcccctgccgctgctgccgctgc

SEQ ID NO: 273 - DNA, 500 bp, Homo sapiens
tgggcggagcgggcctggaggaaggggactgggcagggcgctccggggcggggcggggcggcaggacgcgggtggccgggaggggcaccgccagggcgttaccgtcgcaggaggggcagcaaggcccctggcgcgggtgcgcgcagggcgcgggcgggcagggcagccgctggcaggacacggagccgtcgaggcagaggcagcggcggcagggatcgccgggcggggagaagtactcctggtggcgggcgtgggccgcgccgggccgtgggcagccggcgggggctggggcggctgcggcgagacagcgcatcaaaggggcccaggaacaggcctccgaggggacccccagggaggagcagccgaggggtgcggcccctacctgggcactgcgggcagcactctcccggcagcaggacaggctctggacagggcagcggcacgcagcggcgggccaggcactgcacgttgccgctctacggaccgacagacgcaccacg

SEQ ID NO: 274 - DNA, 500 bp, Homo sapiens
tattttatttaaacaaaaaatgctaaacattaattttagttgtacttaattgaataatttctcaggggaatcgttcagggagagtttaaaactgcctgtttccaaaagccattacaaattggcatatactattatgtcactgtgccaaccaaaacagcacactttaatgtccctgaggccgccttcgctccagatgtgttcagaactcctagtaatgtaatgcaggcaaaaaccatatttacatgaagtcgtgttttgaatatccttttccaattatctggaatgagataatagatccctaattggaagcactggggggaaaaaaagccaggtcagtggttcctcccttgtgaatgcttttattagtgaaaactaaaacagtctgtacaaaagtaagagaaatctcctttgccacagttaatcatcggaacatctataaacttagaaactgccctatggtcacctctaattagccagctgatttttaaaagattgatctt

SEQ ID NO: 275 - DNA, 500 bp, Homo sapiens
agcttaaaaagaaagaaatggcttaggctcctagccaatatattcagaacaaaaccaaactgtttgccagcttcccaaactattgcaatcaaaaccagacaaaagaaggagaagataccttctgcaacctgccaacattttaaccggcgcgattcttccgctgagcgcgcgcctcagccagaagttggagtgccaggccaagagcgcacgctctggctgcagctccgcgctgactcttcaaatgattgtcgttttttcctctcctgctgccaactgctcccggagctcaccagcctgtgttctgaagccaacagttcatagtaaaccttgcaatatctcatgcaatcgtaatgcaattagtgaggcgcgcgctcctgctgggcctctcccctccacgctctgagcccccaaagaagtcaatcaccgtgccaatttcaaggggctccgagctgggcaagggaggctcaggctgccctgcactttgtcatttctgctgcctc

SEQ ID NO: 276 - DNA, 500 bp, Homo sapiens
cctcaggccccgcctgtgcagagtgcgcggaggccaaggagttattggcagaaaagcaagagcggaatgagcttgcgtacttgaagtctgtggccgtctgccaacatctccttcaaatatgaacattcttattttcgctctggaagtttttgtcaggtttattgcaaatgcaagggtggtgagcagacagaaagaaaatggtatttactgagctggaaggactgttttctcaaccgtttctcaagagcacgcaaggagacgtgcactttcctgggtgacatcaggttctccgtggggattttaatccaaatcagatatggccttgttttacgagggatcctcttgggtctcagggtgtgaggattcataataagtacacgtccatccagtacatggcgaagaccattgtaagccacccctggaaacacatacaagacagatgggcacgcagttcacaggatagcgcagaattctaatgaatttcattggcatcaaatgtt

SEQ ID NO: 277 - DNA, 500 bp, Homo sapiens
aggacttcagtaaaacatactttggtgacaaacattttgatataaaattttgtaaaagcacacacatcctgatgggaagaggatgagtaatttctttttaattcagagcaagtgttctaatctggctgaaattctgggaagtgctggaaatccccaaagcaaagtgccagatgccatttctggatcctggatacgtgggcttggttgctaagatgatgatgcctcctccccttcaccacattcagctgacgcctgagcgacagggagttgatgtacgcagagcacggatctaacaatgtcaactgtgctgacatcatcctagctgtgcagggctgatgggaattcagaatatcaaacatcatatcaagggcagtgagcaggtgtgactcatttccctggagaagtgggagagaggaagggagagggcaggattatctcacactgacacacacacagcctttagactgagctatttgcgtggcttatttaaaagcagcaaa

SEQ ID NO: 278 - DNA, 500 bp, Homo sapiens
tgcatttttctcaatgagaatcgtctcccctcccaccccccccactccaacccactccaacccacctagatatccccttgtaggcccagagaggaacccacaaaaagcttccccagccctgctggcagcccggcagccaacagcctcccaaggccccggcttggcgggcactggcccgggctattttatcagtgtgacaattgcccgggttggtgtgataaatcatcgtaagtaattcctgaaagggtgcgagactgttgggggccgggcgaggactgtaaatctttccggtttattgctctatgaacatatgctccgattgaagaaggcttagatcctttcctggagacaaattcccgcaaagcagcccccctctttggctggggattaacacttgctgctggccgtcaggtcggcctctggcaagaggctagggggcggggtcctccgggtgggggtgggctggggtcacccacgatccggcttcgagagacgccccg

SEQ ID NO: 279 - DNA, 500 bp, Homo sapiens
actatgtgttaggttatgatgaagaaaaattagtgtattgtacagagggaatttcttcatggaccataatggccgccaagaggtcaactctgcctctaaggagctggtggcctttctccctccgtttccctgtgcgatgatgcaagggaggacttgcagcttcacagtgcagagcagttggagccctgagccgtcccgttgcaccgccgctctgtggccttccgctagtgggcgccgctgagcggacttcggcgcttctgcctcagcactccagagccccacagcctgcgtcaatttccaatcctgactgacgcatgtggggctgaaatggccaggattgtgaaagtcggtggaataattcgattccatcagctattctaaaggtctgccctggccctctggttttgagtcatgcccacactagaagtttgcagttttgccaccatggcctgttgccattgaaacaaagttcatccttggtggaaaatgctgatcttcat

SEQ ID NO: 280 - DNA, 500 bp, Homo sapiens
gtgcctaagaatagtacttttaatttcacttgtgtatctttaattggagaagaggcacatatggacgggtggcagatgtagaaaatactttttaaaattacttgagataaaagttaatgaggcagcctcgctgtgtccccggatatttgtgggttgcagcggggctcagtggtcagtatttctgtgtggcttgctcgggtttggcaacgacgtactgtaatgatgatggatttcagtctttaaaagctccgggacagcctgagagtaggggtcaggggactcaagccgacctccccaccgctcatctcggactctgacgtcctctgcttccagcactgtctctttcccggagtctctactggggcgctccgggtgtgcagaagtattggacaaatggtcagtggagcaatagtgacgaaataaccctgctcctggctttgcggccaaggagaaaagctcagccgggaagggcacgggcagggaagccgggcaccggggct

SEQ ID NO: 281 - DNA, 500 bp, Homo sapiens
gcggcctgaaggcggctgtctgtctgctggcttaggggaaaggtcagaatctgggttttccttcttggatggaaatttttttaagggcctacacgtcaggaactgtccccacaaagaaagagtgggtcccagaacagcgcagatctagagagaggccctaatcgcgcgagcgcgcacacacacacgccctcttgcacacacccggctccttcaggttgccgggacctcgggaggagggagccgcaaggtcgtgacccctgcctctgcccgagcgcgcccttcggcccctgcaattagcgccgggaggtcagcaggaacccggacgccttcacccgcggctcaaagcacagcaaaaggcgaccccatcccctcccctccgcgggtctcagactccagggcgcagccaggactggagccgaccttcccgacaggcaggggttggaggcctctgaccggcacccgcatttgtcaccttaaatctacaagtcacgaaggtgctg

SEQ ID NO: 282 - DNA, 500 bp, Homo sapiens
cctggtgggggagggtggttaataaagccgccatccttgggatggattatttttctttctttctttctttttttctttcttaagaagaatattctggttgttcgcctgcttggtaaccctgaccctggcagaagaatgagggaactcattgcttcaaattgtcgccaagcccattaggctacctgaactgtctcagaaagtgcgggtggctgcgtcgaacggtggtggctcagaggaagagattggggccggcagcgacctaggtacctcactctgggtgggacccagaggttgtaacgttgtctatatataccctgtagaaccgaatttgtgtggtatccgtatagtcacagattcgattctaggggaatatatggtcgatgcaaaaacttcacgtttcttcggaatagccagagaccaaagtgcgacatggagactagaagcagccggcgctggtcagccgcctcgttctgttttattaccttggactccaggaggat

SEQ ID NO: 283 - DNA, 500 bp, Homo sapiens
cagaatcgggcgccaagcacaggcaggggccggggaaagaacaggaaaagagagagccaaactgaccctgggccccagtgggaaggaggtcagaggggccaggagagacgcacctagaaaatcccgggaactgcgggatagggtggaaacagcacgcactggcaaagcctgcccaccacgggtggtgacgcggcctctgagagcgctccaagttcgtcttgcgccacggggtcacgctcgtccgtgggccggggaaaaccgagaagtaagggccatcccaacctcagtcgcgcacaaagggagcccggccaggtttgggtgggttactcaggaccagagagggcgccttcgccctctcggcgcggagatgctagccgcgggggcctcaggcggcatctggcggcagagcccaagacaggccgcgcaccccgcctgccctctgaggcaagttactgggcaactccccctggcacatggggcaaaccaacgggcgcctcctc

SEQ ID NO: 284 - DNA, 500 bp, Homo sapiens
ggaaatttttttaagggcctacacgtcaggaactgtccccacaaagaaagagtgggtcccagaacagcgcagatctagagagaggccctaatcgcgcgagcgcgcacacacacacgccctcttgcacacacccggctccttcaggttgccgggacctcgggaggagggagccgcaaggtcgtgacccctgcctctgcccgagcgcgcccttcggcccctgcaattagcgccgggaggtcagcaggaacccggacgccttcacccgcggctcaaagcacagcaaaaggcgaccccatcccctcccctccgcgggtctcagactccagggcgcagccaggactggagccgaccttcccgacaggcaggggttggaggcctctgaccggcacccgcatttgtcaccttaaatctacaagtcacgaaggtgctgggccctgcaggctgcggtagctgaccctcgtagggactgctgctcccgcgagtcatggcctttgtccttg

SEQ ID NO: 285 - DNA, 500 bp, Homo sapiens
tgacttcgacgtatgatttttttttaagggagtggagcagacttctgtaaaacagggatattgcagttgaattatgaagtttctgagttggggagattgggtgaggcaggagtaaaatgcaaaagaaatcccctctggtagggatacaagaagattgctatagatggaatctgaaggggaggtgaggctggcttgctaggaagaacagagtcacagacctttctagtgcttcagtttagatcttcctaacgtttagagagcttactgagtcgtgtataggtccaaccttaagcccatctcccactgcgttatttaaatgtcaaagaatatgcatgtgtatttctaaactgttctttgtgggtaccagtgtgtatatggacattacaagtagcccagaatataacattaaatctcagattttagaaatgcatcacaatcacaccccatgggcagactcctgtttcatcaatatagacggaactaaatttgttttgcagcta

SEQ ID NO: 286 - DNA, 500 bp, Homo sapiens
gtcctctttcgcggcttcccttccccaggaatgcttcgcgcccttctcgggaggcagctttttcgagcacgagggccgcccgttgtgcgagaaccacttccacgcacgacgcggctcgctgtgcgccacgtgtggcctccctgtgaccggccgctgcgtgtcggccctgggtcgccgcttccacccggaccacttcacatgcaccttctgcctgcgcccgctcaccaaggggtccttccaggagcgcgccggcaagccctactgccagccctgcttcctgaagctcttcggctgacagcccgctcggctcgccctctcccccggaggccgcgccctcccggaaaagccgggtcctccagaccccgaggccttgctctcagagcgggaggccccacccactggagagccccgcccctaaggtactatgagtcctcaggggtcaagttcagaaacggcccagccagacctaaacccacacgcccacaaagtggattgcacac

SEQ ID NO: 287 - DNA, 500 bp, Homo sapiens
gtctgaaagacatttggggaaaattcatagaacatagaaattcatattatacatattcatattatacattcatattatacattgtgtatattatataatatatatatagtccataaattagtaaatgtgtgcggtgtttttcttgaaaccgttagcatcctagttggtattggtggtactggttgatattaacacgaatgacaagtgggtgattttcaagaagcgcccggtccctctagagaatgcgtccgaatatcagcggagccgactgcgtatgcctccggatgcccatctataaactctcttgcttgtagctattcctcgctccccaaccatattgaccattcacccggataaggcaatttcctcgaaagggcgatctgaggacgctgaccccctaaatgactgaggacgctggatctttagggggaacatcgtgtcttgggggtgccaaaagtccccagcccttacccacacctttgtcacgacgggcaattggg

SEQ ID NO: 288 - DNA, 500 bp, Homo sapiens
gccaggagttggggccatgcggaaaagatttacagttaagccaattggggccgaatacagccatccaaagtttgcaggtgtaaatagtgcctcgaattattgttttcttcctttccaagcaacttcattgcccgacccccaccccccaccctttccccacttcctgggactctaattcttttgagaacagggagaggaggaaggacggtatggcacagttgggatttttctatcagagaagttaaaatacgatgttgcattcacttttatgtgtgcgtattaatgcagtgaatacaaccaggacaggctccttcatcgcatgtctccatctagaatttgagaattgttggagtcagtgaaagaccttttgacttcgacgtatgatttttttttaagggagtggagcagacttctgtaaaacagggatattgcagttgaattatgaagtttctgagttggggagattgggtgaggcaggagtaaaatgcaaaagaaatccc

SEQ ID NO: 289 - DNA, 500 bp, Homo sapiens
ggcagagaaggtgatggggagtacaagttgagatcctgtaattcttccgcaatccttgcattttggagctagcattggtagtcattaaaggaccgagtctgaataagtaggtctgtgttttggtccagctatggcctcacgtactgggtgccctttgaaaaattctatgtaaacagaatttttgttaaaaaaaaaaaaagcgtcaaagttcacaagggaaagtctggtctctgaaggcaaagtcacctgcgacatgtcccttacccccggcatcagcccctcttcccctgggtgggctttgccgccctgccaccaggtggcctgagatgaaattctgacagtgagtgaggacagggttgttttcagaagccagccgtggggagagatggcagcggaagaagggtgactgccgtcgcgctgtgggtcccccagccccaaatctcagagccgcactcccctctcacacaaacactctctccaagcggtaggaaaggtgcttc

SEQ ID NO: 290 - DNA, 500 bp, Homo sapiens
ccagtggatctcgccctgcttttagatattgaaatggagtcaatggcatgcaaatgacactttaacacattaaagtatttggaagccagccatctgttttgctgtgtggccctacactaataaacaaaagatacagtataaggccaggcaggaaatgaaagaaagggttgaccgtctttgaagttcttctccatccacttgagtcttttacaggcaacctcagaacccagcagctgaggggagggcacccggtgcccttgatatggccgcagcaactgcaccgcaaagttcagccttctcttctttgacagggaagtgcaggaattctcacaagtgccctagacggcctgcaaattccaaatttttgtagggtttttctcctccagcccgtcctttgtaaaacaccctttggggaggaaggaagtcatctgtctgtgtttgttttcaatgctgtaaattttctgctgtactgttgggctaaataaaatgcctccaaaaat

SEQ ID NO: 291 - DNA, 500 bp, Homo sapiens
ccctgatttcagcactgaaagtcctgtgtcccagaaaacccctcagtccctgggaaccagtgagggctagtcaccctacctgaaccctgccctgctgtttacatccccttctccccccatctaggcacaatggagggggaaaagttggcggcagctttccttcagtttcttttttcctatcttctgagaaaatcaacaaaggtctgttgaggtcctgtgatcatattttctctctcttcttaattgtaccgctcattctggatgattttctatatccctacaatgctttttttaacacactcctgactcatgaattcttggtcccttgcataattccagaactatttcctctttgatcttgtattgtatgccttggaaattcaccggagccatatatgcagttttggtcacacctagttcgtttaatatgagcagttcttctggatacttctccaggggttactggcaatgttttcacagatggtggagcagggcttctg

SEQ ID NO: 292 - DNA, 500 bp, Homo sapiens
tctgggtgtgttccccttaactctaaaaggagaggggtgagccaggagtgattagtttggaaacagtccaggggcagagagggtggggctggattgtatggagtggggagaaacactgctcagctgggtttttacaagtcagaatgggtatttgaagaggacgctgctttcatcctgctgggtgcaaggtcagctgcagatgctctttcattgtttctttctaatcagcttctaagaatgtggcttaaacgctcagctatttccaggtggttggcatcatttattgagttgtctgctagagttatttcatacgctgcctaaaatgactcaaaaaacaaaaaaacaaaaaacaaaaaaacccaaataaaacagctgtatggcaaacatgctgatgaggacctctgcatttagttgcttcgactcagcgcacaagttaatttaatgttttgagtttggtgacttattcaaatcctaaattgttactgctgtagttagtctgt

SEQ ID NO: 293 - DNA, 500 bp, Homo sapiens
caaactgtctagattcttaaattcaggagcgtaattcaacaaatcaaccttcttactcctctccttaatcctgaaagaggtgcttgtggtttaaataacccagttggtttctggcccccattcctgttccaggagccccattgatgtaccctgatgacaagggagtcggattttctttttttttttaagctgagtgaggctgaagtgttcacccaagacaagccagagaggcaggtgcaatccatggtgcgtttttaattagatcccagccactgagctgcccatacttcaaggacacagcaggcaggaaactgatctgggctgtgtctcccaagggctgacgtctccatttagggagcgctcctgaagctaatggtcagtgacagctccatttgaaaaacacagaaacacttaacagggaggctgtgatctgccagccctgtaagctgctgattagcagggaaatcacgctccctctgtatcgcacccccttggttaat

SEQ ID NO: 294 - DNA, 500 bp, Homo sapiens
ataagcaggacgatgtcagacatctctaacacccgccacagctgcctccatgtctaaaaagacaggatcaggaagagaaactgaaaacagagtccctctccagcctgatcccaaaccaatttgaccataggtcactatgccccactcctgtccctagagtacactgtcacctccagattgtgctcaaagtagctgagtttctcagaggagtaagccccatgaatcttcccaagatagtcttggaagctccgttcctcttggctcattagttgctccttggacatctcatagctccaaggaggacgtcgaggaaagtccagaactgggaattcaggaaaaagtccaagtgtgaggaaatcttcaggattcaagagtacatcccagacccctccttcctcacagtcggcttttacctttccaaactccttccccagcccaatgcctgtcttgctctcactcacctgagccaggctgatacacctcccggatgtccagctcca

SEQ ID NO: 295 - DNA, 500 bp, Homo sapiens
ccagcctctgccgaacagtgcggagccagcacctgggactcaaactgcagcagctggcccatgaagctgaagttgggagagatgatgcttcgcctctgcttcacaaactcaaaggcctcgtccagcttgactcgattagtcctcataaggtaagcaaggcagatggtggctgaccgggaaatgcctgcctggcagtggacaaacacccttcctccagcattcttgatggagtctggaaaaccaaaggagcggctggttacttgagagttcaggagaaccaccccaagcccaggtacagtgtatctgagaaaggtcatgtgtgtcttgtctagaaatggtcaacatcaccacatgccatcacatggatactgttcatggaggcaacgtgggcactgtgcaaaggatggcacaggatttaaactcagactggggatttccacttagcagatagatctcagaccagtcaattcaactttgtgagccccactttgcaaatctgt

SEQ ID NO: 296 - DNA, 500 bp, Homo sapiens
agctgaagataactagtgctcctggtccatgccattcatcaattggaagaatgccaagctgtttccgctgaggacagaaggcattggtctcccctgcaggaagccactgctgctccttaattgtttgctagaggaagaatcaagggtaaaatttaaagtaaatggctggccgagttgcactaattcatcaaagcatgtttcaagtcagtagtcagagcatgcatcagcccccggcgccaccagcttctacgagagtggaaaagccagcagacctccgagcagatgaaatcattaggaggcattcagcagggcttgaaaagcaaagagagaggaggcggggatttctctgcatgctccctttgccacatgggaaacaccagctgtctgtgacctagttatccaagaaaggaaacacggaagagaacccacaaaactgtttgctacatgagaaccccattctccaaagacatgctggatgttgagaaaacaattagcatctt

SEQ ID NO: 297 - DNA, 500 bp, Homo sapiens
cccacttgttgatttctttcttggcagagtatgaactaggacacaccttgtgttcctgtgtggcaggcgtgactggatccaagctttctcccctgcttgctttagattttcctggacatttcttagtcatcccagcactgagcttctatttttagtgccactacctcctaggggacctaaaataaagctggcttagcttcctgctccctcattggcttgagtgttggtcacagagcggaggattggctgcgttctcactctttccctacacgattcctccccgctggctcctctggctttgggcgaggtcacacggactggagtgagctagcacttaccatgttgagctgagggctttatcatgttcctttagagaagcttcacaaccaccggcactgtcaggttgccatccccatcttatagtggaggaggctgaggccctaagaagggcagtgacttgcatcagatcccaccactgcgaatgcttgtctgctggggtg

SEQ ID NO: 298 - DNA, 500 bp, Homo sapiens
cgtgggccagtcagccctgactcaatgctcacatattatcacacgtgcggctcatcccattgttagaggataccattgctgagccaaacacagggcactgctttaaacagacttggctaatttctgcacccattacaagctgatacgttaaaaaaagaaagccagcctactatcatctgttttcaaatgtttccaaattgctcttctttctcagaatgacagctttggaacattagcgcaaatccccaccgagatttgcatccgtattcttggatcttattcagaacttagccctgctgaaaaatacacagttaggtcaaagtctgttcatgggaaactagtatgcgtatttcagaaggagctctcacctacaggctaccccgaggcagtggctggaaactgcaccaaaccctgtgtgtgtatctgtctatctgtctgtccaggcaagaacatttggaattttctagtgcagttcttggtgctgccatcactgaagcaac

SEQ ID NO: 299 - DNA, 500 bp, Homo sapiens
tatagagcaatagcaacatttactattcgtgaagtcgcccctccataatttttaagtctttccatgtgtctggaagcttgtttctgctcttctcggtttacagagcggctctcttccttccaaacaaaaactaaaaagaaaggggaaaaggtggggggtggttggggtggagataacacccagattccttaagtgtttttaatccagttgaatttccctttggactcagctccctgctgaaactgtctgcggaccagaattccaggctcagaattaagtcaagagggaaagacagcagaaacaaataacagagtcagctctatgctatgaaaaccgctatgttgactgaggctccacggttttaacccattcatttttccccccttttttagaattcttacttaatctttttaaccagcttacaacaggcaggcaagcaccatataaaccatgctccctgcgccgggggatataaaacaagtttcttaagtcccttgggt

SEQ ID NO: 300 - DNA, 500 bp, Homo sapiens
atcccttcagtcagttcagtgtgacataagtttctcaaaaatacacatacagaagaaattggctttggcacatttaagagcagcagggaatttgcatctcatgctagtttaatgtgcactcttaatactctcgtctattttctaaaatataatgctattcttgcagaggcagctggacccctgtaatacccagtcttgtgccaagctatgtacacaaatacactctttacaaacacagatgtgaaatgccgtgctaagacacaagcgaggcatagagagagattcgcgtgtttagtctagaggctccacacccaaaagtttcagggacagagctgatgtttgaagactgagaggggagaccgcccctccagtactttcatccgggcactatggagatgacccccatattcccagcatcactttgccctctgccgtggtgacccgggttgagatttaatctagggccagaggggggcaagacaattgtgctgttggctact

SEQ ID NO: 301 - DNA, 500 bp, Homo sapiens
tgcagcctctcattatcacacctagcctcctcctcatcccttgcttctgctgtcgctgccacctgggataccttcactgtctctgtttgcctcgccaattccagcctgttcttccagcctgttctcccaatccttggcaggctgagacccgccccacctctgaaccctgaactccctctgaaaatctgtgccaaggctctgtccctgggagaatcgtagcagctcttgaattttccattaaatattttgcgggtgtgagtttgggctctccagtcagggtgatctggcagttggccaagctggccttcacccagagtagtgaccaggaagatcgcgggcacctcttgacccccagactgagagaagcagctggacccaaacacccggtggggctatttttagttgctggttcccggcaggcctggcctggtttgagcctggatggagaacaatgagccattgaaccttatcgagtccctgggccctgtaaggccaggaga

SEQ ID NO: 302 - DNA, 500 bp, Homo sapiens
ttggcctctgtacaagctacgccgcgcgcgtggactcactgggagaaaacacggggaaatggggagtgctcagtgctgcagagaaaagagctcctatagaaggtgacagcactgttggtgttagtggttcttcaaagatactgaagacagtgcaggttagaattttttttaaaggaattaaaatgttagtagcttaagtatcgaatgtttagtgcttgttaaatagacaacaaactactgaggaatgaacgggggaatagcacagctataaggccttcgtattgtataataatttttatcttgtactctatttttataagcagagatgaaatgttgagattcactgtgcagaggagcaaacttctgttaattttatgtggggtgatgattgttagaatgtttgtaagtgagccttgaaggaaatttagagatatatagtgtgtattcagttttcccaatacttctgaaatagaagccggttaaagtccatgctttagaag

SEQ ID NO: 303 - DNA, 500 bp, Homo sapiens
aattcatgaaggagcatttgggacgccacagaggaacatacacaggtatccctcctcctacccgacaccattcaggaagagcggttacccctccaatgcactgaagcagattcatttccctcaggactgtgggaggcgactgaggctgagtgaatgatacagccttttaatttgtttttaattgtcgtgtcctggtaacccttccaaagacccttcacggagagtagttttatttttccacttattaaccgcattcactagactggaaaaagaattccctatctcccaagaactctccctttcattcttgtaattcctttttttttttttttttttttagcaccaggaaagtaatgtgtgtaaaactagagccaagtatattgtggtttcaaatacaagcctgtttggagcagaagcccgtgggattgctgcgtttcagcctcaggggatggcccgctgatggcctcggcctgtgaaagggaggggcttgaatggccctt

SEQ ID NO: 304 - DNA, 500 bp, Homo sapiens
acaatgacatttgtgaaggcagacacctacacaaaaataaataaggtatattctcatatgtatatgtgtcgtcgggaataatactggtaggtatgtcaagcatgaagagattctacaaaaaacaggggcgagcaaaaagaaaccggatcacacactgagtcctttctcttctgccccattttgtcagatggacttgatgtacccactatatattggtcccgaatgtgctgagttcagcaaatgtcttgacgctaagtcatcaccataactgcttagaaacccagaggaactcgggtgaagttaaataaataaggaccagccctctcgagcccctcccagagttattgcatttctcctctcaaggagcatggagtcccaatgggatgtgaagagcctcacctcccgtggcctttcagcagctgggagaggtcgtaatggggctctgaaggtagctcagcgcactgttcgtggagtggacagggatggagacggggaagttg

SEQ ID NO: 305 - DNA, 500 bp, Homo sapiens
gtgtgaattgccccctcctgaccgcagtgaggtagggacccccgcaaggacccacgttcacaccagcgcccttccagccagtggtggggtatggatgggcctcgctggtcctgggcatggtccggtgcgtccataagggttccattgagctcatccataaaacaaagaagctattgcaggctgcagggtgtcatagctcgcacagtagccatgcagacctaagaggacaatggaaatacaaattgctatcgatgtgtctttattttctagaacttttttttaaaataaaagaattaagtgaaagcaattccgaaggtttctatgaaagcccagcccatccccaaatgcccagtctctggcacgggtgatctggctgtcttgggtactcaggccttactgggatttcctttaagacctctgggaggaagtgtcagtagctgggcaggccttcttggcaagcattcctccctgggttgtggcgggggctcccggcctgctgt

SEQ ID NO: 306 - DNA, 500 bp, Homo sapiens
ccctggattttggatcgattttgcagcggctctggcggctgcatgtgtttcccttggcctctgaggcattccagtgatgatgatggctcggcggggtcacggccctgtacaaagcaagggctatttgtggctgatctaaaacataactggagccacctgcatccgaggctggcttctcgggctctgggtcccataacccagctggagtaaaaagttcacgttcccgtgtggagtagataccaaaagtgacgtctctttctttctttaggtttggctgcgtaattggaaaaccaagctgcccgccaccttgccgtggcttcttctatccctagggcctggagtgggcttcctccctcccctcctctatctaaaccctccttgctgcaagaccctgctcctttcacggagtctccattcccagaatgtatgtgacctcattgtttgtcatccatgttggggcttttaagaatatccccttgcaccattttatgactgcttca

SEQ ID NO: 307 - DNA, 500 bp, Homo sapiens; identical to SEQ ID NO: 276

SEQ ID NO: 308 - DNA, 500 bp, Homo sapiens
gatagtttttctcagttctgggaaaataaccttgtttcctgtgatgcactcttcaattcctcactttctctgaagcaacgatgtctctgggttttggatccatactggtttgagaggggaagactgaggggaggcttttaaagcagttcttgctgtttctttcttaaatataattagatgcgcctcattacctcacactgaaggacttttgtactttttcgagctgtgttttctgagatcttccgtgggcgacggcttgtcgtttccacttgcagttaattgcattagcaggtattttccccccgcccctcccgccccggcatatttgtcctctcttctcgctctccccaagatatctggagtcgattttgcgagtccgaaggccacacccagggagtctgcttgtgcctgaacgtgatgaaggatctggattcctttggcccttcccagtttccctttcctccacctcattcttttttcttaaagtcttccccggacag

SEQ ID NO: 309 - DNA, 500 bp, Homo sapiens
gtggagggaatgagtaggtgaacaaacgagtgagtttttcgcctcactccctggcactcggcaccgagggctccgacaggctggtggccagggctgaccagccagagtttcatctaaaagcctcgatggctatttttgggacaaatgacccaccacttccaatgacttgctccgaaatggcatctaatttcattaagccttggaaacagtgacatcacaagtgcctgcccggtagccgcccacatatggcgaaccacagagtgatccgagattcgtctgcaagaacaggggagaactaaggtcccaagcagcaaaagttaaaatagcaaagctgaggcattctgctatgaaaagaaattacagatgaaatccattagtcagacatttccagcggcagtttccttgcttgggagcaggggaagacgtgtttattcggggttgggctctgcagccattcctcactctgtaggcaagatgtggcccggaaagtgggtttctgt

SEQ ID NO: 310 - DNA, 500 bp, Homo sapiens
cagcgggaacccgacttaaagggacagccgccctccagccagccaaggctgcaagcgggaaccgcagggagacagcacccgccccacccctgccccacgtctgcgcagcttcgtgctcatctgatcctcacagggacttctccttctattacaaatggtatttctttatgataaatatttgtaatattttcctgcaaaagagaaaaagcccacaggctttggtagggaagatctgggtttccattccagcgctgccgctggtgatgggacaatgggcgggggctctgagccacaggttcctcggggcacatgcagacaaaccgagaccacgggcacacagcaggatcaacataggtgggtctgtcccctctctagacagattcaacacttcaaaatatgcagccaagctctctcttatcaactcagtagattaaaccgggtctgcttttgttttctgtcttcctcactgaccagtgcaatctagtgctggtactcgggct

SEQ ID NO: 311 - DNA, 500 bp, Homo sapiens
cgtcctggtcgctattgttgcggatcaggatgcggccagagaacagggaggccatggtaacctgggttgggtgctggggacagcgcggcgtgtggtccccggtctgctgactggctcctctcccagaaatagaaatctttagaaaaccagcttaggacttcactaatctgcctaaaccttgacctgaggggcctctaagggcggggggcagggctctctgtgtggcccttctcaggagagagccgcaaacgcattaagaaaacacgtaacagatgggcacggtggctcacgcctgtgatcccagcactttgagaggcagaggtgggaggatcatctgaggtcaggagtttgagaccagcctggccaacatggtgaaaccctgtctgtactaaaaaataaaaaaattagccaggcgtggtggtgggcacctgtaatcccagctacttgggcagccgaggcaggagaatcgcttgaagccaggaggcggaggttgcagtgag

SEQ ID NO: 312 - DNA, 500 bp, Homo sapiens
gctagcgctggaagcagcactggacgcaggaaagcgagaagccggctggggcgtaaagactgctctgggacccacgggagtccctcgccccgcttagaacagccagcaatgactagggccgtccccagaccagactagtccgggtcgcgtgttctgacacacgaaagggaggcgggaccgtgaggctgtccatggtgctgaccccgtcctctgcctctagaagtggccagaaatgtgagaacgctgtgccgctggaacccactgcctccctgcagctatcagttctgcaaatgcaggcatcaggagtccaccgctggcactcagccaacacagtgggacccactgagaggcagtctgccacaaccaaagtctcccagcattcttatctttttccagccccaggatccaaattgtagggctgtctgacaggcaccatgtaacagagggtctctagcatccgagtgctttcagaccacaaatggctggcccatctgcttttg

SEQ ID NO: 313 - DNA, 500 bp, Homo sapiens
cccttgcacccctggatcttctgctgagtatcggattggtctgcgtccaagagctcctcgcttggccagcaggggctgcctggagaaggggaggacaggcttcgagttttttgggtagtgacttctgtggacgtgaaaagactgcaccagaaatcggaggcagccctccaaacataacttggcctcttcgttctccctgtggacacacaggctgtgttctcctggccaagagtccaagcgtgtttttggcgcgtgctgacactctatatcgcttttgcttcggaaacgaatctggtcagtgacttagccactctataaaaatgaagagcagagctcgagtgcttataacacgtcatttttacccaagacagagaagaaaaacgaaagagagcctgagcattcctttgactccctccacccccggaaggtatattcagagtctccaagactgcctccgcccactcacatgtttatggcccggtgagaccgcatcctccctt

SEQ ID NO: 314 - DNA, 500 bp, Homo sapiens
ccctgaccctaccctgaaaggcagcctattgaacagtaagctctcaccttgaggtcggggatcccgtagcccttcttgagggtgatctgaaacacgtcaagcccgctgatgtacgctgccaggcgggagaggctctgtttgccactgccgcccacccccaccagcagggcattcccccggggagactccaggatgcgattaatcctgcagatgtgagccacggcgtcctcaaacagcacctgcagaaaccggagagatcccacaacatcttgtagcacctggaatcacctctgtcaccagcacggactctgcacatgctgaggtgtgcactgtgtgccacgcagccccacacaatgccactcggatgtcgataatgcaaccggagagggtgacccggtccaggtcccgtgcccttgctatcagctccagcctgctcaccaaattcatgactgcattaacttcattgtagctgtccaggacgtccacgaggagcttgttca

SEQ ID NO: 315 - DNA, 500 bp, Homo sapiens
cggattgcctttgcagcagttccgccccacctgactcactccagggtcagccccgggtgggtttcaatgcggctctggggagggggtgggcagtgggggaagtgaggcttcctatccgccccctctcacttcacatttaaatattctgcacgttccagcccccgcggactcgcgtaccgcccaatccgccttcaccgcacgaaaaacatcactagcctgctctcagcccaggggacgactagtccctggcgagaagctgcctgcaaggtcactgtcatgccacctgccccaagtgctcaggggaaactgaggcttcctcatccccttcaccttcaacgtcgctctaaacacggcaaagccccgtttccatgctcccagagttcagctgaggctggaagtggggtcctgggcttctctgggagcaattttctagtcactctgatcaaggacgttactttcccagaaagctctgaggctgagtccctctgaaatcaagtcct

SEQ ID NO: 316 - DNA, 500 bp, Homo sapiens
attactttgaggagtgaacttatattaacggtgctaaaccgtacatgaacgacttggtagatgaaaactttggaaaataggaacatttcatgtcatcacatgtatcctccagcattggggaaaattcaacagttgccttaaggcgggagtttaattgaggacatttactaaaaagttacttattctgtttgaaattctcttctgataaacatcttcccgggataacgaacatctccaggatgtgagagccgagcgcgtgtccgcggagtgcttgagcaacgcagaatggcttcggtgctgcgttccttagaccccgtgcggaccctgctgagccctcagcatctgtgagtgagtccctccgcgtcaccttggcctcccgtgtagctagatcagtcttccgaccccttgttctacttgcacagatttctgattaacctcttctgctcctccagagatgagtcagggctccgtatcagctccccaaggcatttgctggcttc

SEQ ID NO: 317 - DNA, 500 bp, Homo sapiens; identical to SEQ ID NO: 198

SEQ ID NO: 318 - DNA, 500 bp, Homo sapiens
aaccttcccgggcttctctcccgtgcactccaagccctcatagctcactcttgtcagctgtttggcgaaccctcttatgctatttctttcatgcacttttaagcttttttggtattgcagttccacaaacctcgtgctcccccacctccctgtgcccaggacctgggggagagttctaacctgcggctttttccccagcccctgctgtggaggcagcctcaatgctgaaaatggagcctctgaacagcacgcaccccggcaccgccgcctccagcagccccctggagtcccgtgcggccggcggcggcagcggcaatggcaacgagtacttctacattctggttgtcatgtccttctacggcattttcttgatcggaatcatgctgggctacatgaaatccaagaggcgggagaagaagtccagcctcctgctgctgtacaaagacgaggagcggctctggggggaggccatgaagccgctgcctgtggtgtcgggcctg

SEQ ID NO: 319 - DNA, 500 bp, Homo sapiens
attcagccctttttctcgccactcagcaccctgcagtcttaattcacaaggcccgagttcccttggagggacgcgcgcgcgtcgagccctcatccccacgcggcggtgcaagcgcatgaatggacactggaaggccgtgcaagtttggtctgagccgcccccgctggcttttagagttagagtcccagcccacctgcggtggagcaactagcttcttgactgccctgaattttgtgacatagagccccccgtggcccaaaatcaagaaacttacttgttttgtcatggagtcaatgaggcgcacgtagaaatcctgctccgtccttatccctagggttggaaatgggggaagggaggagaattaagtgagaggttacggagggtgggtggacaataattaacaacaacaaaaaataacaacaaaacccccacacacatatcacgaaaggggctccaaggctgattggaactcccactgtcctggaaaatacagccacgat

SEQ ID NO: 320 - DNA, 500 bp, Homo sapiens
cgagatgaaggtcacagagtttgggaggagatgggatccggcactcgggctggcgagcagacaggagggaactcagggagatgggaaccccggggaggaagttagggcaggatcccctgggagttttcccggatacataggagaaaaggttatccttcaagggtgagcgggggctaagtgcaggggacagaagagaggaaagcccggcgaccatcatgcccggctgccgtgggtggtctggattggaggcggcagccgggctgtgtttgtgcggagggtggcagggggccagcggaggaaactgcccaggcgccagccctgccatccccaccggcctcctcgctttggggttttgctttctgccctggccacgtgggaccggctaggtggagatcatgcaatcagggttcccagctctcagaaccataatggttaagcaagcagcttcgtttccaggcacgcaggagctcccccgtgtcagcgttttcctaacatggcta

SEQ ID NO: 321 - DNA, 500 bp, Homo sapiens
gagcctgaccccgccctaggattcctggagtgggtgtgcccacgcttccggcccagacgtgggtggagggatcccaccctgccaggcctcccgcctgtgcggcttctttcaactcgatgagaggaggactcctcctgggcctggtgcttcgaggtccagacgagcagacactggcgcctgtgaccctgcagcggacgcccttcaaagtccgtgtggccgcatttggaagcctgggcggcgtggagacggcgccttcagcttgagatagtaagttgcccaatgcctgcacctgtggagactcccagcacctggtgggtgagccgcagggggctcgggcctccatactgggtctccagcagcaggggtgaggtctctcctgtgatggactcaaatgactcaaacccactgggctctgcccgaggcatctgcgctatggaagcagcttgcaaatgggctctctggggccacgccggcccacggcggccacagcctcggccagg

SEQ ID NO: 322 - DNA, 500 bp, Homo sapiens
tctcatcattcctggggaagccgcctctgccacccctcctccgccccctcagcccctcgcccctctgcttcccggggaggcctggcttgcttgggtttcaaaggttcagcccactccgcaccagggtccctgggcacctttgagcccttcggggctccctggccgggtcagaggaaattcagccctttttctcgccactcagcaccctgcagtcttaattcacaaggcccgagttcccttggagggacgcgcgcgcgtcgagccctcatccccacgcggcggtgcaagcgcatgaatggacactggaaggccgtgcaagtttggtctgagccgcccccgctggcttttagagttagagtcccagcccacctgcggtggagcaactagcttcttgactgccctgaattttgtgacatagagccccccgtggcccaaaatcaagaaacttacttgttttgtcatggagtcaatgaggcgcacgtagaaatcctgctccgtcc

SEQ ID NO: 323 - DNA, 500 bp, Homo sapiens
aatgtcccctggctccggccccatcgtgaccccagcccactgtcccccactccacacccaccacttagtcccctgctccccgacctgacctcatacccatcaccttgtcccctgatccccaacatcatatgtctccagtcccggtccctctgactcgtatccctctcccagctgcgctgctgcggctggcactacccgcaggactggttccaagtcctcatcctgagaggtaacgggtcggaggcgcaccgcgtgccctgctcctgctacaacttgtcggcgaccaacgactccacaatcctagataaggtgatcttgccccagctcagcaggcttggacacctggcgcggtccagacacagtgcagacatctgcgctgtccctgcagagagccacatctaccgcgaggtgggcaggggttcggagcataaacctgtcgaatggggcggggcctgcgggagggggagggctgtcagtgagtagcggcctgagaaagggcg

SEQ ID NO: 324 - DNA, 500 bp, Homo sapiens
ttggcaccccaaagaaggcaccgcaagtgaagcgtggagcctcaaacctgttgcgtcgggtccctagggagattgctgggcctttggggaaagaagtggagccacgggagtccggaggcggttacgcggaagtcttctagcttttctgggctctccgggagagttgggggctccagggcatacaagagtagtactggagtaaagacttcgcgattgcctggcaggcagggctttgggtgcatatggggccgggagtggacagaaggggcgggtctgatattcccggggctggtaatagatggaaggggagtcttggagccgttgcaacgatgcaggcggggcaggtgtgttgggggcgcgggttatggagcgagctggctttgggtagagtggaaggggcgggccaggcctgtgggcggggtctccgtgtcccgcttttctgagggcaatgacctgggtgggctggaattggcgacgaaggtcctcgatccagcggtctc

SEQ ID NO: 325 - DNA, 500 bp, Homo sapiens
acgaggaaggtgcgtgggactgggcgagggactgggcgaggcagggggtcctgcggaccgcgtgcaagaggggacgcctccgggtgcagatctgcgagtctgtgcccacggtctgcatgcgggctggggcccagcccggtgccagcgcctcccctgtacccacagaagccgaagctgaagcccgggaagtcgctgccgctgggtgtggaggagttggggcagctgccacccgttgagggtcctgggggccgccctctccgcaagtccttccgccggggtgagggcaggagcgagcaacagagatgtggggaaggcgggagtttggttaaatttggggagtgcccccttcctcctacgtggcccacagtctgtaagtctgtgaaaattgaaacccaggtcccagtgaccaccacactcccctgggtggttcgggtcttgggctagacctcagacgtttggaaatctccaacggtggtgtcgctcccagggatttacacctg

SEQ ID NO: 326 - DNA, 500 bp, Homo sapiens
aggcccctgtctacattcctgaagacattccgatcccagcagacttcgagctccgagagtcctccatcccaggggctggcctgggggtctgggccaagaggaagatggaagccggggagaggctgggcccctgcgtggtggtgccccgggcggcggcaaaggagacagacttcggatgggaggtgagcgatcgcgcctgagtatgattgatcacggccatttatcttgtgttcaatctatttataaagccgggctgagcagccactgcccgaggcgggaggcgcggccagagagagcgttcaaatgtcacatttcccagcctattttatcctgcagctcgcctgatgcgactcagaaagcatcagaggtcctcgtgggtgcctgtcagccctgtaggccacgcccactctctcccggaaatgtgtctttcatgagctcatgtcttaaaacatcccgtgcttcccgccggatcccaggcgcgaacactgccatcgcggcag

SEQ ID NO: 327 - DNA, 500 bp, Homo sapiens
cccggacccccgagcggcaggggcagcccgtcgtgccaccaggcgtcagcaggcttcagtcagaatggaaacagccatgcccttcgcgaatcccgtcgcggcctctgggaaccgagctcctcgtcttccttcctggagggcctccttggtaggcaaaatgggtctggacgggcccgattcggggctgtgtttttcctcccaggcgaatcccagagctggtttctgggtggctgtgcaatgccaggaagccgacggcatctttcgggccttggcatggagccaggctgggagcggatgaaagcgccccgcaggagccggcagagctgtctggttggaggaaagtttctagggagaaaatggctgtgggagtgacagccagtgaggggcagccggtccctttgccaggtctcccgggcacctgaggctggtgcgggggcgtctcggggctgggggccacccctggggtgcagacacccggcttctcaaggcatcttggtcgg

SEQ ID NO: 328 - DNA, 500 bp, Homo sapiens
gaccggcaagcagagctcggcagagagcgacgcctgggtgctacagttcggggaggcggagaaccgcctgctgatgggcggctgccgaaacaagtgcctctcagtgctgaagactctgcgggaccgccacctggagctacccggccagccgctcaacaactaccacatgaagacgctgctgctgtacgagtgcgagaaacacccacgagaaacggactgggacgagtcgtgcctgggcgaccggctcaacggcatcctgctgcagctcatctcctgcctgcagtgccgccgctgccctcactactttctgcccaacctcgacctctttcagggcaagccccattcggccctggagagcgctgccaagcagacctggaggttggccagggaaattctcaccaatcccaaaagcctggacaaactatagggtgctggggactgcttgaaaagcgacacaaacgggcgtgctctctcagacacacaactctgctataaacagc

SEQ ID NO: 329 - DNA, 500 bp, Homo sapiens
catcaatcactacagcccctttattaattccatagaaaaaaaaaacaacaacaacgaagacacatgcttttggatgcgaagcactggcagagcccttgccaccgcaaacggaaagagggagggactcctgacccatccaggaggcgaaatagccccgcggcagcgccccacccctctgccctgccccttagggaaaacccccgcggagcctggcggggaggaacacgcgaccttcgcactcacctggcgcggccaggtctccctggccccagaaaaaggccaacattgatgatgaccttacctttaaaagaaaataagacgtttgtattccccactcccatttttttcttttttttctgctttggccacccgcggcaggtggtgcagcagccccgctctgagcagggatccgcggagctcgccagccctagaccggatcccagggaggaggcgcggccggagccaaagcgcagaggcctccctccctcgcgcgccgggtc

SEQ ID NO: 330 - DNA, 500 bp, Homo sapiens
tcccttccttcccaggtggagatgggagtgggggagaggccaggagcccggcggctgcactccccgcggtgccctgcccactaggtcagggccgggggcgtttccatgagggccggcggaggccttgccggcgccctcactggagcgcagcttccctcggaaccaaagccttgacggggatttcctctccttgagcccccggtgggctcctctgcctccttttgtcaccccgttcctcagctgtgtcttcgtcccccaccccggcctggtgccgagggaccgtccaaggggtccccgtccgcacctccctgccctgattccgggcgctcactgaaagtctcgatgatttgccaagccccccgcccccgccccccagcacagccggtgcctgctcagcgtctaggctcaagcccattccgggtcacctggagcacagctgtctttaaagagcctgcaggttcgctgcaggggtggcggtgaccccgatgcctgcagaaact

SEQ ID NO: 331 - DNA, 500 bp, Homo sapiens
cagggagccccggggcacagggaggggaaagacacagaaagcgggggtgggacagggtgcagcacctgagtccccgtgctgcacgagtggctgggggagaagctgttgtctggggagccccagggggtgcaggagcgtgtggacaggaccccacaggccctgcggctgaggacgccgtgcacaccagagtgtttctgctcctctcccctctctgggcgtgaaacggggacatgggcacgcgtgtgcagccgtgtgtgcgtgtgtgaaacggggacgtgggcacgcgtgtgcagccgtgtgtgcgtgtgtgaaacggggatgtgggcacgcgtgtgcagccgtgtgtgcgtgtgtgaaacggggacgtgggcacgcgtgtgcagccctgtgtgcgtgtgtgccgttgggctgagtgttcgtgtgtcgggcatccatgtgtgttgtgtgcacatgcatactgtgtttgtacacactccacccacttctgcatcctggtgttt

SEQ ID NO: 332 - DNA, 500 bp, Homo sapiens
cgcgggttccccaccagaaaatggggctctggcctggctcgcggaccacgtagtagtctttgtcaagcggcagcagcttagctaggccgaagtcagcgatcttgacgtgtgcctcgctctccacgaggatgtttcgggcggccaggtcgcggtgcacgcagcggcgggagcccaggtactccatgccctgcgggcgggcggtgtgagcgtgcagagaggatcccaggataatccggcaggtaccccaagcgtgacctggcaccccaacccagaccccaactataaccctacccccgagccatcctccactgaagttctgatcctgagccctaagccaaccccaccactcccgagacctggaccccaaaccactcctcagccttcaccgcgacctccaagcagacccctgcccaggccgtgccagctgaatccccacaagtcccggggcgccccctcgcaccttgcagatctgcgaggaatagagaaggaggcggctggca

SEQ ID NO: 333 - DNA, 500 bp, Homo sapiens
tccccgtccttcttgccaagcccctgtcccacaggtaataaacaagaagccgggcccgtctcgccgcccaggagggcagagcttgcagtgccctgcggctggtaaggctgagggtcgcccgcttgcagtcgagccgtggtgaaccgagagtcctgcaagttggacgggctcgctttccagaaaccagagacaaactcgatatttacaaactcattctctggcaatgaaaacttgaaatgagttgagctccgcatttgcgcgcctgcaaattgctccagctgagtgcacgggaacacagcccaacagggactgctttccggcaaacctggaggccctttgcaaggtttttctgcttgacagaatggcagctgtgacctgggagcccaagcaatggaggacgggtagagagaggcgcataccgtacccgatcggcgtggcgggtcatgctgcgggagtctcggcgtctgttcctgcccgggcgctgcggacgcggcctgggc

SEQ ID NO: 334 - DNA, 500 bp, Homo sapiens
ggcggggccagagttcaactctccaagaccttcgaaggggcggggccaggacttcgccctcgggtctcgcgcagtagggttagagccaggaatcagcccccttgtcccgccccccggggcggagccaggccctgctcccaccccggcccggcggaccccgcctcacggtgctgagtttgctggcggtgagcaggactcttctctcggccaggagcgccgcgaacagccccacgatgttctcgtcagtcacggccaccaccagctccgttaggttcctctgaggatcagagagtcgctctgggcgtggacgggcccctggatcttgcatccccggtccgggtttcgggacctgttctcacccccagagacccctccccactcacgttctcagggatggatggcaggcggccggagtccggggccacgaagcaggaaagctggtgggggtattggcagggggatcaatcagtcaggaggctggcctcacctggacccccgac

SEQ ID NO: 335 - DNA, 500 bp, Homo sapiens
ggtgctacagctgacagagcggcttcgggacgcggagaacgaatccatggccaagattgcagaactggaaaaacagctaagccaggcgcgcaaggagttggagaccctgcgggtgaggctggggcgggtggtaggccaggcgcccaagaacaggccagctgaggcttctaggcttgacatctccctccaccccgggaagaagatggaggcttggtgccaaggagcctgctggtgggcactgacccctcccgtggggttcgtaggagcgcttcagcgaatcgaccgccatggggccctccaggcgtcccccagagcctgagaaagcgcctcccgctgccccgacgcggccctcggccctggagctgaaggtggaggagctggaggagaaggggttaatccgtattctgcgggggccgggggatgctgtctccatcgagatcctccccgtcgctgtggcaactccgagcggcggtgatgctccgactccgggggtgccgacc

SEQ ID NO: 336 - DNA, 500 bp, Homo sapiens; identical to SEQ ID NO: 200

SEQ ID NO: 337 - DNA, 500 bp, Homo sapiens
gaggctggctaggtggggcgctcagggtgcgcaggcacgcctcactcagttcgtgtgccttggggtggcccccggcgctggagggagactggagggagcaggcgggtcggtggtactcgccgtcggcgcccaaagcggcggacgccgggtacggctgctgattggcattataagcgaacccgttggctgcctggtaggggtagccaccgtagatcgccgagctgtcgtagtaggtcgctttttgcatcgcgttgtttcacgatcttgatcgcacactctgacaggggtttgacacccgtgagggcgcacattggcacgcccccgcggtcacgtgacactccgccgccaatggccgccccgcgcagacctggtggggcgagaagcgcagcgcggtgagggctccgcgcaaatccatcttactctcaatagctaagtgacatgaaagccataaaagaaaaagtggtcagcaatatttagcagcacgacttggccccgggcgc

SEQ ID NO: 338 - DNA, 500 bp, Homo sapiens; identical to SEQ ID NO: 280

SEQ ID NO: 339 - DNA, 500 bp, Homo sapiens
caaggggacgcccctgggctccaggtcctttgcaggccttagaggccctgcacatcaactgttctctggagaacccttctgcaagcctctgggatgtagctgcctcctctgctgagacactagccacgcctcgtctccttccaggctgctgagccagtagcgttgaaccctctcacctgccgtccccgcctttcctatgccctttgtccttgtaggttgacgcctgtgtcagcagagagaggaaagagacgcaggcgatcattctcccgtccttacgtggcagacagggttatttgcgtagattgaccgagatgagtgtcctgcactctgaagaaccttggtggctcctccttcggaattgatttaagcagtggtagcatagtgttttgaagacagtcaacggtgggttgggtttactggaattgcccaaggtgtttggatgaaggccttcattaagcaaggcccttggcgggacgttctatggaaccagccctgaatgg

SEQ ID NO: 340 - DNA, 500 bp, Homo sapiens
cttcaaccaggatgctgaacatcagcgccaccgcaaaaatggtgttcccaaatgctcccacaacatctgcccgaagaaagccgtaagtgctcttcttgtgctgttttatgttactggcccttacaccaaaaaaacctatgatcatggacacaaagtgggaaaggacggcaaaagcatcggaggccaaggagagggagttgccaacgtaagcgatcactagttccatcacaaagaggaggatgctaacgacgcacatgaggattaaacggaagcttcttccggagtatcgccccatggcgtctcggtgccctggcagttcctctccctttcttgggaaggctgagctgctagggaagcagctatagattcagtgattacaactcctgggtaactcttcccttcagccctccggcgcttgtcatatttggaaatcaccttttataggttgctataaagccataaaacagtttaaagggcaattaagcaagagatgtcacatg

SEQ ID NO: 341 - DNA, 500 bp, Homo sapiens
aagccaacagctcagggcagcaacaagaccgaggtgggtggcggcatcctcaagagcaagaccttctctgtggcctacgtgctggtcggggccggggtgatgctgctgctgctttctatctgcctgagtatcagggataagaggaagcagcggcagggcgaggacctggcccatgtccagcacccgacaggcgctgggcctcacgcccaggaggaagacaggtgaggcctgactgtccccttccctccccggatcggggatgggcacgcacgcatgcacacacatgttcacacctttccgtggtgaaaagactgtcatctacaggctttattgtcccatgttcgcccatgacgcctctgtcaaaacggtttatcattttacaaataactttagacttttctaccagagcttcccaaatagcatggtacaaatggattacaggtaaaccaagattttttaaaaattttattacaatagatttttacaccatggaatactat

SEQ ID NO: 342 - DNA, 500 bp, Homo sapiens
aggagagagaagaccccagcagagtcaacactggaggtcctgcggggtgggtggtgctggggaggccacacggggagggctgttccctgttcccttcccctcaggagacagctggcccgaggtgacacagcactggatgcgatttcagggccagggaccatggtgcccggggctgtggaccacgccagcccacagccactgcaagccccagaccggggctgtggataacgccagcccacggcagccacacgccccagaccaacacgagaagaacgcaggccgacaacatcttcatctatggtaggtgacccggttatcgttcctaagagagtccacggccacttctactgggttccctatactcttcccctgccccagctggtccccccatgacagccgtgtccctgagaatgggatgcagagccaggagggacgtgggccccttcagtttgcaggggctgccaggcagcaccttccacctgccgagggccggaggcggg

SEQ ID NO: 343 - DNA, 500 bp, Homo sapiens
ctcccctggcccaagcactagttgtaaaagtcgatttgatcacaaagtgaccctgcgtggttgttttgggagcgcagtggctgaaggcgaaggaggtgggggtgtgtcgagacttgtggaccaggtgactgctgagaaggagaaaataagccaggtacacaactgcggaagagctctccagggttaggggaaggctgtgtccttgtcactgctgtgtgtccctggctgtacactccaattgtctggaggcggtggcgtgttggacagtcctggttgctgagtcatgctaaaacactgttgttttgactcactttgtgacgtaggtctttctcaccagtcaagaaaatataatccggagatagcctctgggctggctttagctcagcggttacttcgagtacattgtaaccacctctctgggtggttcgagacccgcgggtgctttccagctcttttactgctgaagttcagctccttttccatggggaaccatggagaaa

SEQ ID NO: 344 - DNA, 500 bp, Homo sapiens
cactgtctgtgccggtgtctcgggcgggggccagtgtggctgccaatggggcaaggtgcgtgggacgtcaagctgacgtcactgtctgtgccagtgtctcgggcaggggctggcagggctgcccaggaggctgtcggtggggcagttcctcatgaatctctgagctgagtttgtaaaagtgtgtgagagtggggaaaatatgggtgaaaatattttcagacatttggattcccctttggtgagctgtctcgtttcttcccgctggtcagggatgtggctgcttgaacagctgggcgcggtgaccaatgtgtggagagccgggaagcctgcggtgaggccgcgcgatgtccttcatcccgggcagtaaatccagccccgagggtggggcatcctcccgggcacaggctctcctgcctggggtcgccgctgcgggcaggacatatgggcctcccaagcggtcccatctacacaggtcgggtagagtgagtcggaaaggccac

SEQ ID NO: 345 - DNA, 500 bp, Homo sapiens
gacaccacctcagacgagtacctgcgaagttatttcatctacagcatgtgcacgaccgtggccatgttctgtgtccccttggtgctgattctgggctgttacggattaattgtgagagctttgatttacaaagatctggacaactctcctctgaggagaaaatcgatttacctggtaatcattgtactgactgtttttgctgtgtcttacatccctttccatgtgatgaaaacgatgaacttgagggcccggcttgattttcagaccccagcaatgtgtgctttcaatgacagggtttatgccacgtatcaggtgacaagaggtctagcaagtctcaacagttgtgtggaccccattctctatttcttggcgggagatactttcagaaggagactctcccgagccacaaggaaagcttctagaagaagtgaggcaaatttgcaatccaagagtgaagacatgaccctcaatattttacctgagttcaagcagaatggaga

SEQ ID NO: 346 - DNA, 500 bp, Homo sapiens
actttctcctggaattacattattggagcttttctttttaatcagcgcataggtcaacatgctgtcaatgattaatgtttgcggcatgactaaggtgcttgacagttgtgagctccgccgtcaatgctctctgagacggagaagaccactgggcctaggagaggccttggcgccgcgacctgcacgcccgctatgcgcccagatcatccgcagctgcgggaggggccgtggccagtgggtgagtggcagcgtctgtgagcagcacagagcagcacaggaaacgactccagcgcggccccacggcccctgcacgcgtgcagacctgctccgaggttctgttctgatgcttgcctccctccttcgcaaacgtgatctttaacatttttccagttgtaagacattcagagctccgacattcagtcactcacttcagaaaacaggagcattaggaggaattttggtgctaatttaggttgccccctgcctctactttatttatt

SEQ ID NO: 347 - DNA, 500 bp, Homo sapiens
tcctctctgggcctcagtctgtcttctgtaaaacatgggggtggggtggaccagatgaccttgaaatatcctgccagctccagtggctgctgagagcccacggaggcagcggggagcctccaggcagccagagcccgggggccagcggaaaatgtgacttcgttacagctcggcccccagtggcgctgctggcctctgatctttgaacatttccatagtgcacccgacacgtcgggcccggtcatagcccggcgcagcccctcgctcactcaggaacatctgctacagcatttaccacgttaatagattagctttgagaatcgggcaggtgttttccaaccaagccagaaaacatcaaaatcacattgctctccaagcctttccgcacaggcaatcgagttagaatgactcatatggtctaacagataataaaacacacataacatttgctttaaggtacaggtgggggtattttgtcccgcacataggagaaacaaaaa

SEQ ID NO: 348 - DNA, 500 bp, Homo sapiens
tttatacatatatccattccttcttttttgattgtctttctgtttaatgggcagctacctctcttggcatctagcagaatgagctgctgcagtttacacaaaaagaatggagatcagagtactttttgtgccaccaacgtgtctgagaaatttgtagtgttactatcatcacacattacttttatttcatcgaatatttcaccttccggtcctgcgtgggccgagaggattgccgtacgcatgtctgtacgtatgcatgtaactcacagccccttcctgcccgaacatgttggaggccttttggaagctgtgcagacaacagtaacttcagcctgaatcatttctttcaattgtggacaagctgccaagaggcttgagtaggagaggagtgccgccgaggcggggcggggcggggcgtggagctgggctggcagtgggcgtggcggtgctgcccaggtgagccaccgctgcttctgcccagacacggtcgcctccacatc

SEQ ID NO: 349 - DNA, 500 bp, Homo sapiens
cttatccccttgtaggtcaaagataagttaaaacctaactgtataactcacaatcagctataattacagggcgggcagtttcttacctgctgtttattgccttttcttgttaacatgacaaacggcattgtgtctgcagactcagcctctccttccccacctcccagtgggggccctttcctcagctggcttttgagatgcaaaggaatggcaacatctagttggtgcactttaacagattcaccacttcgttgctaaaagaaattaaaaaggacataataaacactccaagatatatacggatatatgtcaatataaattgcaaactcattcaatgctgtatttcttaaaacacaacaatcataagagccataacagtcaacaattacaaccaccataatactctttctgaaacgtggataaatctagggagtatttctccctccacctaacacctctgcctatgacatggaaggaaatgcaggacttggctgctgttg

SEQ ID NO: 350 - DNA, 500 bp, Homo sapiens
tgaactcagggctttctgatctaagccttgaggacagctccaggtggtcctatagaggctctgttttctgcgtgaggcagataaatgttggagaaatgtggcaacatccgattcaccgctcatggctgtgtactgtctgcttttcctttccaaggggagaggtgacagtccctgaaacttgaccaccattttcttcccccgttaatcaacattagggtaattggcacgctacatccatttacagtgtggcgtgtgtgcttgcggctctctataaataatgaaaaaatcacagtaatgaccagaaatgtgtgtgaggcgtcgcggcgagcgtgtaatggatgctttgtttgtcttcggggactgtattaccagcatgtaactgattaggctttaaaacgctctaggttacctgaggcccggaaggtgcttcatcacctctgagtctgttctcctctgccgggaacttaacagaggtccaatatttgcttttggttccccct

SEQ ID NO: 351 - DNA, 500 bp, Homo sapiens
tattgattacatgggcattctctatactattctgcccacttttatatgtttgaagttctctgtagtaaaaaaaaaaaaaaaaaaaaaaaaaaaatttaagctacagatcataaaatttgaactagtaccacacaatttatttcctgttaagtagtttcttccatgtcctttgagcttggtatttctcattagcttagcaagacagctgggaggggatttgtttgttatgttttgatggcggaagttacacgggtactatgctgcttttataaaggacttgcgtcgtaaagtcttttttcctcaccctagtgacttcttttcttacaagaatcttggaataaaatcaaaaatgcttagtatgatttaaagagactttgtgtagtgtatttcatgtcttcctcttctactttatgttagtctattttcttcctaccctctatattcaataagcactggcttttctgtctctagaatctgcctcagtgtctttacactgcctg

SEQ ID NO: 352 - DNA, 500 bp, Homo sapiens
accatggagagattctgcaggaaagctatgttttgttgtaagacacattagctcttacaaaaatctttgtcttgactttttttttttttttgctttgtcttgttttgtcttgctctccaagcatgtgagctgaaacaaatgaataagtaaaacgtctatttaatgaggattcaagctatgtagccccagaggaaggaagtaggacttttaaaataaagaacgtcatctattctctgccacagactggaacgtcgtggtgtctcagcaccagcccaagcactttggagagcttattgaatcccatcctgaacagcaggtggtaggtatgttattttccattcatagaggctgaaactgaggttccgaaggctgaagtgacttggccaatttgcacaacttgtaggtgctgcaactgagattcaaatccatgctgccccaactctcaagccctgtcatcaagcagggacactctcctttccttagctgtgacatgttactct

SEQ ID NO: 353 - DNA, 500 bp, Homo sapiens; identical to SEQ ID NO: 257

SEQ ID NO: 354 - DNA, 500 bp, Homo sapiens
tgggctaaaaatagccagccaagcctaacaactagcttctgattggctcagagcaaaggccactcagccaataagagcttctgggaacaaaagcaattcttttgtgtgagatactcaacccacgtcaaaacagcttcaggctgtagaaatgattttggttgagctttaacaaggtaataatgcatttcagccctctgaaaggtttgaagcggaacaaagggagtagtgaaatctacaaaacaaatggagcgctcaaggctttcatgggatgaatcatccgggtgcctgagctacaaacagttgcaagctcagaaaagaaaaagcgctaggattttctttctttcttcctgagattttaacttatttttcaagcgaaaaacaaaacaaaacaaaaacaaaaaactaacgaaaagccatcaaaggcgttgtatcttgactatgcccaaatttgttattatgcttatttgatgatgaataaaaagcaattcttccacggttcc

SEQ ID NO: 355 - DNA, 500 bp, Homo sapiens
cctgctgcaatcctggtgaggtttaattctctgtgcaggcagagatggctgctttctgggggtctgtggggatggtgctgaaaaacaggtctgttgctgggaaagtggacagagagggaggctcaggattgctgagctggagggtgctttaggggcaggtcagcaggaacgaggcacgtgagggtgtgctgatggatggcaggggccgcgctggggctggggctggggcggcagggaggcagtggtggccggcgtgcaggggctcacgtagctggcagagccagggctgtacttcctgctgactcagcagagcaggcaggaactgattcttttcgactaatgtgtcttctcccaggattagctcataccgctctggctgggaaagggggagaggcagcctctcccatctccccaggcttaggggccctttggaggagagggcaggcagactatggggccccagcaggaccagtaactgactctgtatgtcctcgatctca

SEQ ID NO: 356 - DNA, 500 bp, Homo sapiens
aagtgcaacatctggaagtcagatatacagagaacaatttatggagtgtgagagatttgaaatattcagtgtcttttagtgggaactcaactttctggggctgcttttttttttttttttaacccagcacaaagcaggcaattctgagatctcctttgcctctctgaattaaaccctttgtgcctgggtcccataaacaatgtgctttttaaaggggagccccctcccagctccggcctttttctccagcgtgggcagccaatcagctgcgcagagctgcatagctggaccgctttccattctgagtagcaacaacgtactaatttgatgcacacatggatgcctcgcgcactctgcaaattcatcacccgcatcttgcattagtcatctgacggactgccaagtgtttcattttctttccatgtgactttattattaccacctctctcctctcttccaaaaacctcccaaaaagggcggtggggcggggggcggggcag

SEQ ID NO: 357 - DNA, 500 bp, Homo sapiens
gggtagatacaagtgttcccttcccgagggtgaggaaactgaggctcggaaagtaaaggctgcatggctagtaaaatggcagagatgatcggcagtgacaaaaatgatttgtcgttttgagatgtgttcaggacacaggcagcatcttgttagctgggtcaggtgacttctcttcggttaccaaggaacggctctgaggaaagtccaagtttcttttgtaacttgcgctccatgtgacagaaacatgagcgtttccaaaatgaaaacactgggggctttcgcctggaggggcgcagggacagccgcccagggccgaagtaaggggcagctcccctaggggccctcggggcacagcccacagcccgttttctgaggagactgaaaggggcaaatgtggccaggagagctgttttcacactaaactgaaagaatgcatctacttcagaggctttttctcccttgagactttaaaatcaacttggttcctttttaaaacttct

SEQ ID NO: 358 - DNA, 500 bp, Homo sapiens
ggttccctgacaaacagcgtagcgtgttccatccgtgctggctttgcaggagggcatagagattgctcgggatacgccagagcccttaagcaacctcacgtgctgttactgaaaataagtaaaaaatattttaaggaatttcataggagctcaaaaaagcatagcaacagttaagtaattggggacagttgaagtacaagaagaacaacgagtgatgtgcttgtctgttgtgtcggaaataacccagcacgcggcacttcctgtctctggataaggtaggtatgcagccatggcacgtgcgggaaagcgggacagcgccctctagtgttggaaatcccactcacaactagcattgtgcgatcatagagcgcgcttttgtttatgccatcaggacgggtggttttttgttactaaataaattcaagtagatacttggactaaggcgttttatatttttcattagtgggtgggatgagtcagtgcagcagccttgagacatc

SEQ ID NO: 359 - DNA, 500 bp, Homo sapiens
ttcctctcctttcaccctcctctgttcgctgtacactctctccctcgacctgcccatctctatttccaagcagaggccccagaaccacccgctcaggaccaaagaccctctgctgaggggcggggaggtgacccagcttcctgcaaactcccgacttttgccggagccgtgggcgaagcggccatcaatcgggtcacctttgtaccacccggacttcgccggccctggaggctttgctgccatatgggccgctgaacctaatcaacttcgcacaggtcctggaggggtgaggaccggccttggggccgcggggaaagagtttaggtcccaacacaaacactcgttttggtattataaagacatttatttaatctatgaaaataatgtacaataaatactttccccttttcctattattaaagaattttaataaataatctacagtctaaaacataaaaaagaggaaaataggtccctctagttatttttaagaaagtccc

SEQ ID NO: 360 - DNA, 500 bp, Homo sapiens
ttattttggggggctgcggagcaccccaggaaacagcaaggcagctccaagagtccagcctggtccccaccagtgaacccgagtcagcccagtcggccccaggctccgccaccaccccttggcttcgggctggactggccatggtggccccatgggcagggtagggggcctcagggaggtctgcggtgggggcagggcgggccacgtgaggcccttcatcgtacccagctcttcctgccttgcagacaccgaccacgggcccgacattttctcaagaaaagaaaacacaagagcccacatttcttatctgagttaaacaatgagctccgggcgtcctgggaaggggtttcacagtgagttcaacgtgccaggagctcttagcagccgctgccaaggccagtaggggctgcaggcttgcgctggttctatgtcccagcccgaccgagccctccccctccgtggcccgcaggtgacacaccagctgtgatcctgggtaaccc

SEQ ID NO: 361 - DNA, 500 bp, Homo sapiens; identical to SEQ ID NO: 282

SEQ ID NO: 362 - DNA, 500 bp, Homo sapiens
gataacagcttcaaagcgagacaagtaatttccagacactaatttctaaaggaatagctctctagaatcccagttaagaagtatttgccccttagaagactgagaggcaggaaagcgttgatgagggtggaatctttggcaggtgcctggcccaatacactgagctgtttggggggcacgacccacttcctcgggctccttccacccttgcagggagcctgacactgagggctggcggcttttctggcgcgggccagggggaggaggagaaaggagctcccgggatcccctcgccccctcccccaactgcccggtgagtaatgacattcacggagcggggagggagggaggagaggggcaggctcggcgaggccatgtgatgctgggcgagagagagccgccgcgccggagcctccttctttcctgcctctgattccgggctgtcatggcgacccccaacaatctgacccccaccaactgcagctggtggcccatctccg

SEQ ID NO: 363 - DNA, 500 bp, Homo sapiens
aatgtagcaaagcccatccaccagccatgtactaccccccaacccggccaggctggagcgaccgtgtctggggagccgagccccgcttctcgctgcggtgagcccggactggggcacgcactgcgcagactccccgctgcagtgggcggagctcccacaggccccgccccctcctcccaccctcgttcagcctgtccagacagaagctggggcccaccggaggtagctgcagacgcctgagagcgaggccgaggcccctcaggggtaggtggggggaggctggctggggggatgggcagcggggtggcagggaggccccgatgatccctggctgagctgtgtggtgtgggggcacctgagggcggaggagccacctagaatataccccctgtcccagggctgagaaaagccaggcacaaagacctggggctccgctgacctcatccagcgctgcctttcttggggtgtctacaggttggaggagggagaagggggctgct

SEQ ID NO: 364 - DNA, 500 bp, Homo sapiens
ccgtgtgcccgggcctggtctggtccccgaaaccagctttggacgagactcaccctttcgtccagcaatttccacaccaggctactttggagtggggagtcttccacagagatgtgggaaggcgctggggcagacgccttgggaatttgcaaattggtagtgaagtggctaggaggaggcgtgtggggggaggtgggctgcagtgcagacggttgggggttggggcgtccccgggagctgattggctgccgcgggtggaggcggagcttggccgccgcccccggaccgcagaggcccggctttgtgtcagtttctaccccaagatgccgccccagatccgggatggagacccagacgcccgccctcagagtgcagcaggacgatttgtttcaaagtaaatcgttgagactgttcattaacaagggagcgatggataaataatgatgatctctgtgtaaaataatatacaactatttccaaggatgggttaaatctactta

SEQ ID NO: 365 - DNA, 500 bp, Homo sapiens
gagtgccgtgctccctggaacgtgtgcctgcgagggtggacaccctcaccttcagccaacagtctgtcacctgctcctgctgcgccctgggagtccactgtcacccagcggggcaccggcacactgggccgagcatcaggcagtgccaccgcggcggcggcagctccccttctgcggagccaggcttgtccccgcccgcagttcccaccttgcacccggggaggatgctcagagctgtgcagagcccgccgactcagccacgccgccacagactcgcctccccggcagaggcgaaaacaaaagcattaatcttccccaggaggccctttctcctccacagcagaggaggaggaaaaaacccagacctgttttgctcctgttcctcgaattaggatggttccttcccgatgaaccagggcgcaccccaaattctgtatttggcattaaatatcagggatgcttacattgcagacatgggacgcttgcctcccaatccatca

SEQ ID NO: 366 - DNA, 500 bp, Homo sapiens
cttggggaagacagtacggattctagttctgtggactcttttacttagctttgagacccaagcaagttaattggcttgtgcctcttattttactctaatgcaatgaataaagacagtcccagccttcgccctaagggagcaggagcacctgcgatgccccgttcccaagtcctcagggcgaatccgccaaatgtgcgagctgggcagcccacccctttcagctgctggccggaagcggaagtgggcgtccgtcgcctcgccatctcccatagctgtcgcctgcagctgagaaagggttgctgtcccagcaggccaggtccaggtgcgccccactagtgaggccggcggaatcgggagggaaggggtcaagggcacagtgcgcagccccggctgctccagaccttgcctgcagcttcccgccccagcctccggctatcgcggcgtttcttctcagaggccgccggctttggttcctcccggcactgctgggcttggggctg

SEQ ID NO: 367 - DNA, 500 bp, Homo sapiens
aagtagggctgcaggttggggtggtcgctgctgcattcatagtggcggccctggaagccccggtcctcgtagagggtgatctgcaaggcaaggcgggacaaggcgaggtctcacaggcctgctcctgccccagtctctggcccccgcgatggaggaagctccggggtcccggggcgcaggctgggctcaccttccccatggctggctgggcgcacggcggtgctgagctggtggggcggcggcgctgagcgggtggggctgcggcgcggcgggctatatagcaggagggctgctgcgttggcaagaaccgcacaaaaggggcccccggaggggagcaagggcattttcgtgttctctttttttctctttgctgtgctagaccacggggcttgttgtgggttttggtcgcattctctctggagtattcggattgctatcactggctgatgctattgagaatgtttgtaaaacggcaatttgggacattgtctatttataat

SEQ ID NO: 368 - DNA, 500 bp, Homo sapiens
gcaagtctcctcccccggcgaagtggtcgcctcccagtgagtcccccagtggcccggccaggccctgctgctcctgctgcaggaggaagaggttggggccgaataacggattcatggctgcgccttctgctgggagatgcagaccggtgcaggagcagggatggaaggcgagccagaagagccaatgcggcgccggcgggacagagccgaccaatcaggcggctcggcagcggggcagaggtcagggggcgggccgaggggaagccaatgacaggctccaattggaggccggaccctggacctttccgggtctgaggccgagccctgtgatgaggggagccaccgcctggactccagccggggtggcgtaaagcccaggacctccagtaccccatgggttctggtggcaagcccatctcccctacacgactttttttttttttgagaccgagtctcactgtcgcccgggctggagtgcagtggcgcgatcttggctcact

SEQ ID NO: 369 - DNA, 500 bp, Homo sapiens
gtatgttatttagttaaatttgtgaaaattatgagatgctcaccaacccggtgataaacttgctccctcgccattggctggcctggtcacatggctgcccaactttattcagttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcct

SEQ ID NO: 370 - DNA, 500 bp, Homo sapiens
ttagctccaccgccccctcacccgcgtccctggggccctctctcaccgtcctccgcgtctggggcacgggctaccagaaaggtttcccgggggtcgcgcttcttggcctcggggtccctgaggaacctggcgtagaccgtctgcggcgcccgggcctgggctgggtctggggaaggctcctcccgcggcctccccgtccgcccagctgagccgagatgcggggttcagacagggtcccatccgcgggtccgcgaggcagcgcctctacccgctacccccaagcctgggcgcaccccctcgggctcctcaccctagggatctcccctgggcttgggtttccactttcaacacttctccccggcttccattcagcttcccacccccttctaccccaacgccacccccttctacaccaaccccaaccccaaccccaaccccaatccctcccctctcatcactccccgccccctcctcccccaccccgttccagggctcggcga

SEQ ID NO: 371 - DNA, 500 bp, Homo sapiens
ctggccccgcatggcccccggcgccccgctcccgcccgggccgtgggagggggcgccgggtggccgggatagggcgctcacacggcgccccctggcggcctactgtgctgtcggggctggggaagtccgggctgaggctgagtctgggaatgggcccggggtctgaggtctacccggaggtcctggagcaggagagggaacactaggcagcaggtgagcgcagagccggaggcagagcggagctgagcgcggagccgagccgagctgcctctctcctcccgccccctccccgcggctgtcaccgcctcctcccctctttggcgctgccgggattggctccccctacccccgccccccaccctttgcagcccgggggaggcacccggtgaaagggtgaactgcaaagtgcggggaaggagactagctccccagcaatctgcccctaaagcagaagtcacggggcttggcggggggggggggtgggggaggaggagagcgcg

SEQ ID NO: 372 - DNA, 500 bp, Homo sapiens
tggtctcgaactcccgacctcaggcgatccgcccgcctcggcctcccaaagttctgggattacaggcgtgagccaccgcgcccggccttttttcttttctttcgttctttttgtttatttttgttttgttttgttttgtttggtatagaagtgttggaacgtacacctctttcttaaaccatcctgacaaagggaaagggaaaaatacatttcccgtgaggcgttgtgactagaacagctggaggtggacggcagagtgccgcgacgactgccaggagttgtagttctccccggccgcgtcactgcggtgtcgcccacccttcttccccgggcaggccgcggtttcctttgtggacgtggcgaggagtgcccgcggcaccccgtgcactcattggccccgccccgtgagacgctcgtgcgagctcattgggcggggggcggggctctgcgctgccagaggcggggcctgactggagagcggccgaattgggcacatttgc

SEQ ID NO: 373 - DNA, 500 bp, Homo sapiens
ggggagccgcggcggccgccaccgcaggagcctgctggagggtggtggtgatgatggtggcctcgcccgcctcgctcatgcctcctcctcctctgctctcgctcatgcgcctcggtggcggttggtcggcggttagtgcggctggtggtcgccgcggccggggctcgctctcggggaggccggggctgatctcgcggcgcaggcggcggcggcagaggtggggtcgcgcagcggaggcagctcgagcttcgggatgcgcgctcgcttcttgggctcctcgctcgatcttactgcccccttttttctctccctccctcccttccttcctccctccctccctccctccctccctcccttccttcctttcctttcttttcgtcttttttttctttccttttctttcagagtctcgctctgtcacccaggctggagtgcagtggcacgatctcggctcactgcagcctccatctcctgggttccagcgattctcctgcctcagc

SEQ ID NO: 374 - DNA, 500 bp, Homo sapiens
ctcccgctgcccgctgcccactgcagcctatttacctgttcctccagccatccccttagtcctgggccgggagagaccatttcctccttcctggagggatgagccaacagggctgagccccctactctctcggtggtcagcccgcccgaccaccacgcccctcctttctagggccccagctcccgggccgcggctcgtttgcatttcaaagctacacaatgcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcg

SEQ ID NO: 375 - DNA, 500 bp, Homo sapiens
gctccagcagtggaggaagagtccagggagtttcagctgggcagaaggggcgcagaggcttggggccaagcggagtttgccctgcgggtcctgcgcaaggccccagtgccccggctaaacctttgccgcaggatcccggagccggcgtccttcaaggagcacagagggccccgtagcacgccccttgcccagcgccaccgacccttaagcagcgtcaaggaaggagtcccgatcaaggacagggatctgcggccatggccgaggccgcggagccggagggggttgccccgggtccccaggggccgccggaggtccccgcgcctctggctgagagacccggagagccaggagccgcgggcggggaggcagaagggccggaggggagcgagggcgcagaggaggcgccgaggggcgccgccgctgtgaaggaggcaggaggcggcgggccagacaggggcccggaggccgaggcgcggggcacgaggggggcgcacggcgag

SEQ ID NO: 376 - DNA, 500 bp, Homo sapiens
gagctgggccctggggagagagagggcggtgcccaagccaggaccctgcgggccggggctggaggaggcgcaggtcccggcgtccatgtgcagccctgcggccggggcgcgagatctccccgcaggcggccgctccccgccaggggcttccgggagcagccgaagcctgaacctggacgagccgcgaccgcagccggcggggggtgccgtcctcctcgccctccctggagcccggccctgggcccacgccgtgccccgagcctcctctgcggcccgcccccagttcccccggtccgccgcggccgggcatggggaggtgaaggcctccgtggggtgacagggggcgcggggccgcttgtccccagcgcaggaggagccgggacccgacgcgcaccctccggcctgctggaggctgagccgccgcagggaaagcacgtgggtgaagggcccagcgcggcggttccttgaaaaagcgggagcctggtctcagctggggcctg

SEQ ID NO: 377 - DNA, 500 bp, Homo sapiens
gcagacgcccaggggctgggctgtccccgaaagcccaggagaggcaaagcaacgcgcagcgtcagggacgcgggcccaggggcggccgcggggggcgcctggaggagggaagcctctccggaggagaagagctgggcggccgccgtaggaggaagcggaaagataaggggccctcggctcggcggggccgccggacgcccaggagcctcaatggggacacgtcgggtggggacggaggcagctcctgtccggacagcgaaacccgcgaggcccaggagagcggcagccagcgcggcacagcccgggagctgcggcccacgccggagcctacggacatgggctcggaagggacaaaaaccgggccggagtcagcgctggagccaagcagcgacggcctggacagcgactggccccacgcagatacccggggccgggaagggtcgtcggggacggggcccctgggagccagcgagcattccggcggggactccgactcgagt

SEQ ID NO: 378 - DNA, 500 bp, Homo sapiens
cttttgaacaggagtctgtcattctggtgggccatggagtgagtcagtagctgttactcattaaacaaaaggaatcttctgtgagctgacggcttcttcagagtcggatggaggggctgctgtggagatcaggcgcatcctgacaggctggttctggtaggcacgaaaggttcagaagaaagaatttcaaaagataaaaatgcccccagcagaaacaatgaatagcaagcacacgcgtgccaccccacacgcggaagtcacacaaagctgatcgggtttcgtgtgctcctcgtgttccacggagcacctcatctggagtgggcaggtggctccctcgggtctctctccttctgatgataaaccccccagagcgggggtacagctctttaccgcttcctttgcaagtctacgtggcatttacgagtcaacccagtcataaagcaagtaagtctccaacctccggtgtctagtcacagttaaccgtttcagcctctctaggc

SEQ ID NO: 379 - DNA, 500 bp, Homo sapiens
ggggcagacgccgtgaggagccccacgctcggcccaggtggcgcgagctagtgtttggccccaaaaactgactgctgagagccagagatacgaatgaaatgataaatcctgaggtttatttcacatggagtgtttaaagagcagaaggaagtgcgtgataagtgccctttcgcggtgagcacgcgagtctcatgttctctgcccttcccgctctgtgcccttggcagctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggtgaggtcccttgaccactcaaacagccagatgacggtgagcatgcct

SEQ ID NO: 380 - DNA, 500 bp, Homo sapiens
aacctgcaaacccctgagggcgggcgccaaagcaagaaagacagacacgaagcaaagaatgcactcaattcaaggtggaaaccacagtcctgtgaatatttcaatttggaaacagataatgttataagggctctatttctcctgtctgcacagaacatgcccttccaagcacccgacatcaagaacctgggaacacaaatcggctcatcggagagccagctgcttccttccaaggcggggaacgttgcacgacacgccgcctggaactgcgcggaggcagtaaaaatcaatgtttccatttgtggcccatcaaaacatctctcttcttaccaattaagggatgtacagtttttaggttcttttattatcagaacgcgccaactcctggcaatacagaaatcccattaaaagtcaggcagcatatttatctcagggaatctgatctgccgctgcagtgagggtaagaaatagaaagcaaagaaatgagaaatatcatttgg

SEQ ID NO: 381 - DNA, 500 bp, Homo sapiens
tgaggagccccacgctcggcccaggtggcgcgagctagtgtttggccccaaaaactgactgctgagagccagagatacgaatgaaatgataaatcctgaggtttatttcacatggagtgtttaaagagcagaaggaagtgcgtgataagtgccctttcgcggtgagcacgcgagtctcatgttctctgcccttcccgctctgtgcccttggcagctcccctcccacccggtcactccgtccagcaagcacgcagacagcaagcccgcgccgctgacgcccgcctaccacacgctgccccacccctcccaccacggcaccccgcacaccaccatcaactggggacccctggagcctccgaaaacacccaagccctggagcctgagctgcctgcggcccgcgcctcccctccggccctcagctgctctctgctacaaggaggtgaggtcccttgaccactcaaacagccagatgacggtgagcatgcctcgggccctgggtg

SEQ ID NO: 382 - DNA, 500 bp, Homo sapiens
tccatctgattgtgcttaatggattttctgcttcctcagaaaaacttgaatttttaagaaacgtaattgtcatataacagctctgtgtgaattaagtcatgtcatgggtaactctgtgagattttagtatcctcctgctgtgctctaatgtgatgtcataattcccaaatagtctcatgtgcgaggcttggtgtcactttgcttgcgaataccatgcttgaacatctctgtgcttcagcctggtggcagcgtgtgtcccagcacgttttattaggctggtgtgagactattagcagtagagtttgcctggagctatatccacactagggtttgtgtctgtgcctctggcctgtatatctaggattcagatgaaggttttatgagaacagagcatttggtttatatttgtttgtacctgatacaaaactgggatttagctgtagtccattattgattaactgtgataaaagcagacagtgaggtccaaatgttgaaattga

SEQ ID NO: 383 - DNA, 500 bp, Homo sapiens
taacaggatcctttgaacatagctctgttttatcacaggatctttattgaagttttaatcaacacaagcagctgacaaaataggagactgtagattcggctgtacattatgtatcttccttgtgagcctgaaaaaaaatcataacattaaaagaagagaaaataaacagcctcatttaaaaaacaaacgaatcccaccaaaccaaggaaatcctttcgcacccgaaggaaggcctgccgcgtggcgtgccgactgcagtcctagagtttggagcctcatggagatcattaccataaaacaaataaccatctcgtttttgtcacccactatgagtgaactcaaaacctcaggcccacgtccagagattccttctccacaggctcagccagctacgaagggaagagggtaccagcccctgtgtccaaatccttatccttttcttggtccagccgctgtgccatggatctggatggtgactcatcattctgcctggcagagtc

SEQ ID NO: 384 - DNA, 500 bp, Homo sapiens
gctgaaggcaggtgctggcaccaggtcacagacgatagcacacacaccacactattttgcacctggcttttccccagttaccaagtgtgtcccgtaagaacctttttttttttaacagctgtttttgtccattgtatgcacggctggatcatgttgattcaagcagggcccagcttaaaggcctttgtttcttcttttttattataaacaatgctaacctgtgagagtgggctgaccctgtaaatccaacggaggagtcttcggaccgaacggcgaaccgccttcaaaccccaattcttacagccaagccgttcccaaccctgcacggctagggctgggcctcaggccccgtttctaactctgactggggtttggaccccgtttccgcagcctgacagggctggaagctctaggccgacccagttcccccttccagcaggacccgatcctggaggagtgagccgtccacccaggcacagccgcaggtccccagccacggc

SEQ ID NO: 385 - DNA, 500 bp, Homo sapiens
gcgccgtaccaggcagtgaaagcccaaatgtcacgtacagagaagaaacaagcgcgaacacaagatcgagccggcgagcgtggcgggcgaaagagtcccagcccgggcctgccacgaagcggccaccaggcttctctcccaaggtgtttctaaacccggcccacccagcaccaggtatggccctctggcctccacgcccgtgctctctcagcaccctctccactccagtcaacacggaccacacaccagcgtcacacgtgacccaacatgtctctacgagaacgtgatataagctctagtctaggggactgccaaagcacaaactaaatcaaaaataaaattaaaaacaaacttacagggacaaggtggatgtaagccagaagggatggagctcggggggaccaggacgtgccacacaggcccagtgcagccgggtttaaagggaagctagaaatccagctgttctgtgtcaagtctaactgaagtgctggcaaccagtt

SEQ ID NO: 386 - DNA, 500 bp, Homo sapiens; identical to SEQ ID NO: 340

SEQ ID NO: 387 - DNA, 500 bp, Homo sapiens
accaccgagttccccgcgcagggggcaggtgcgccccacctgggtgccaagggaggcgacaccatctctcccccttggggtggcccagccttgcctaccatgatctccagggccggggctcagccctcatgcctgggaacagaggctgctttacggggtgagggcctggggccccccgagccttccccaggcaggcagcatctcggaaggagccctggtgggtttaattatggagccggcgctgaccggcgtccccgccctccccacgcagcctccttggtgcggtccaacacatcaccgggcaagctgaggcctgccccggacttggatgaatactcatgaggaataaaggggtgggccgcgggttttgttgttggattcagccagttgacagaactaagggagatgggaaaagcgaaaatgccaacaaacggcccgcatgttccccagcatcctcggctcctgcctcactagctgcggagcctctcccgctcggtcca

SEQ ID NO: 388 - DNA, 500 bp, Homo sapiens
cccaggagttcaagaccagcctggacaacatggcaaaaccctgtctctgcaaaaaaaaaaaaaaaaattagcccggcattgtggggcatgcctatagtcccagctactcgggaggctgaggtgggaggatcacttgagcctgggaagtcgaggctgcagagagccaagattgcaccactgcactccagcctgattcaaaaaaaaaaaagaaaaaatattaggcagtttatctatttaatctgtggtgtgcggagaccaggaactatcagatttatcattatttgagcaaatggttttattggatcacaatcaaagattttacaatcttatgtaaggacagatgtgacttagtattacttgcagatattaattcgatcatcatgttggctccataactctctggtatgtggctgctggtatggactgacctttgaatgatgactagcaggacctagagtagttacagctctcggttccaggatatcttgctcaaatccatg

SEQ ID NO: 389 - DNA, 500 bp, Homo sapiens
aaggctatgtcaccccaatgggtaggcatgataagactgtttgctatatgaccattctgtgcctaggatttttttttttttaatttgtaaaatgagaggtttggacaaggtagtctcacgggcctgtgtcccccaggtctgacattctgtggttctgcagctcctactagagctcagaaatggctttggaactgttagtggcttaaagacaaaatatgccatctcttatcatgaatgttagggaatgaacgaaagatgccaaggctaccgaagtcatgtcattaaagaatcaatgtttgaaaatcctgtttctaaccatcttcgagcagggcaaagacaaacacaagcacatatctgatctggaaaactgcctgtcctctgtgaaaattaccagcttcaggggctatgacttctacggtcttaaggtatctttcaaactgttaactatggggtttgactttttcttttcgttttttggtggggtggggaaggtcgggtca

SEQ ID NO: 390 - DNA, 500 bp, Homo sapiens
actaatcatggcagagaccgaaagcaatgatgccaggattttggtaagaagcacttttgaaaagacatattaaatgaggaaaactaaacctaatggaatttcttctctcattacttaaaataaaccaggtcactgagatgagcgtacactatggtattttgttcattttcatttcatttttataccataaattcccatggaaatacctcagacacgtgcccacaataattggaatgcctaacatttcagcgtaagtacttttgcatgagttctactaaataaaaagaatgcagtgagagccctccaagttttttggttatgtcaacagctattttacgagtatgaattatctctgtacctataaactacatgtgtaaaatacattacatgagtctgtgtgaagccttaatgcgaagaccaaggtctgagctgcacacagaaacatcaaaataaaactaaacttcctagaatatagcaatcataaattttcttaccaaagc

SEQ ID NO: 391 - DNA, 500 bp, Homo sapiens
cttaaatataaaacaaactcgaaccctttaagggaaaaaaagttcccttatgtatctgctaatctccttgtaaatcttccaagcgtgattaatatgattacttaaacccaactgtccaaaggggatttttgacagttttatgagggaattagttattttctattttacggccggtccttttcctctcagttgtgaagctgggtgtctgggagccagggcccgctgcgctcaacccggcctggttcacggcgaagtccccaggccgcatcctggacgtctcagctgcaaagatgctcccctctctcacctgcgagttcgctttaaaaacatatataatgattaaaagaatgtcttttgtctctctagccaaattactgctaagtagactttccctttccatcacactgaacaggcgtttgcgagccacccgtggcctcccagagctgcgttcctgggatcttcttagaagttactttcaccgtaacgacttgtcctgttct

SEQ ID NO: 392 - DNA, 500 bp, Homo sapiens
gagtaaaaagccatcgctaagaggaatgtacacagaaacttaccaggtacacctgaaggtgaggctgccttgcagaagaccatttcacctgtttgaactttgagaaacattggttcagatctaacactatgtagagttttgagtgaatggttagcagcgttttctttaaaaggggacgtttctacccacaaactaaatgacccaaataaggcagatactatggggctcagccaagtaaaccattctgtccgcactggtatcccagccatgtcttatttatttacctagctttactttagatttttatcttactacaattatagtaggagatctaataaatccagcaataggaacagagagaccttaaatatgtagatagcagccgagtaatttttttttttttttttgagacggagtttcgctcttgtcacccaggctgcaatgtaatggcatgatcttgactcactgcaacctctgtctcccaggttcaagggacgatc

SEQ ID NO: 393 - DNA, 500 bp, Homo sapiens
tactcaggaggctgaggcgggaggattgcttgagcccaggaagttgaggctgcagtgagctgtgatttgtgccactgcactccagcctaggcgacagagcaagaccctgtctgaagaaaaaattatatatatacataaaaactttgcctaagcttctgcttctgccagtctatgtctttgttacagcaattttatggggacatagttcacatctcataaaattcccccactaatgtatacagttcagggcggtgcggtggctcatgcctgtaatcccagcatttcgggaggccaaggtgggtggatcacctgaggtcaggagttcaagaccagcatggctaacatggtgaaaccccgtctctactaaaaataaaaaaattagccaggtgtggtggctggtgcctataatcccagctactcaggaacctgaggcaggagaatcgcttgaacccaggaggtggattgttgcagtgaactgagactgcaccactgcagttcag

SEQ ID NO: 394 - DNA, 500 bp, Homo sapiens
aggaggggagaaagagaaagaaaaacagagacagagagtggcagagatagggagatgggtagaaacacaaggagagagggacagagcaagaaaaaaggaaaccagccaggtagactgtcagactcaaaacacactgatccacagacagacagacgtggagacagacagaggctgagacagtcttctgatcacggaagagagtcggaagatgacagccgagtcagcaggcacgtgcatggcccgctgttgcgtgccgtggcaactctgtgttggctggtgcacgcgtgtgctggaatctttttgtgtgtacatttgcctgcaaacggcattcggctctggtacatgcctgagctggtgccaggcacactagccctggcagaagcacagctcttccccgacagccaggagctgcagtttagttttctctggcggcaacacaaaatgaatagcaggaaaaacccctcaaaatatgggctgcaatatgcctcagcacacactct

SEQ ID NO: 395 - DNA, 500 bp, Homo sapiens
tccttctcttttctctcaactgtaagcaccaattatttggcaaacaatcacaactaaccagaacttagctcgacccacatgtgcaaggagaaagagatcggttttcaatagtagtttgctgaggtaacttcaatagcattttgcaatataatatgataattaccactttttagggaaagaaaaacacgttaataatcctttacctacatctcatgtaactcttttgttttctaatacttggctggtccccgcagtttggggacattcagggggtaagtgcatgataataagaactacttactgctgaaacttgaaggtgtatttaaaacacgggtgatgcttttgtgaatagccatgttttctgtctttaattttagttgctgtttctcctagtcttgaggttttgaagtttctggctttctcctttatgggcccgggtcccatttttgctccagttgagtgcagatacatgtctcaaattctggctgaacatcagctgt

SEQ ID NO: 396 - DNA, 500 bp, Homo sapiens
ctccataaaattttatggagtgaatgaactcgccgtgtttggctcgagcaagtgacaggcttgccagctctgaaggtctgttaaaaggcagatgggaagatccgcctctattctgagacaaacttgccttgtgtggtgcgaggtgaggtgtggggaccggcagcgggcctgccgcgcttcccgggcagcggagccggactgcgcacccagcgccccgctctgtggtgtggggtgtgtggtatctgagcccgggacgcggctcagtgactgtgatgggggctgttcagctgttgtgggactgagttacacgcatctcactggcaaagccacatcatctcaccccacaaaatacggaatttggggtgtcatgggtcaagaggctctgcgctggacagtgtggggtatggtgggtgtgtgtccgtctggacgtgtgtccctctgcctgaagggatgcagggccgtgaatggacccagcagcccccgcatcagccctgccctcc

SEQ ID NO: 397 - DNA, 500 bp, Homo sapiens
cccactgtctggcaaatagaatctgaaagaaaaggagcttcttaaagtgccaaagggcaagccagccttcccttccccctgtcctcggctcccttctgtccctttgcgatgaggtaaaccttttaatctcgggggtggggactggtcccctgtcacgcgggagtctgccccagcgtcggcccctgcgaggacagaggaacccggccctggaggtctgagttgggacgggtcccctccagtgaggacgcccgtggaacagggccggtcggcttggctgggaggaagggggagagttcttctgtcttggcaacctctgggcatcaaaggctgctttaatgtttattcaataaaactgcttcattctttcctacctctgagaaaaggaccgctgggttggcaggacttttttttttttcttagacagagtctcactctgtcatccaggctggagtgcagtggcgccatctccactcaccgcaacctccgcctccccggctcaa

SEQ ID NO: 398 - DNA, 500 bp, Homo sapiens
tttcctgagctagaaaacgggcccacgccatcaaggtggggacaggcccgggctcccttcttgttttgaataaagaccatgttttccacgtggcgtaagacatggcgtgatgacacttaacttcgcactactaaaaataccttaagagatacttatcttgtttaaataatttggaattatggctccacattaaagaaaacaaactccaagcaacagcttttctttctctccttcccttgtgaggtccgccggcaaaccaccaatgtttccgtattcaaggccaaaataccctagggagggaccggactccttttattctttacatagcattgtcagtgtttggggacattggaaggaagctaaggaagctatagtgacaaactcctgccactctcgcgttcagaggtctgcaggacagcaggctcgtgagccggggagcgggctgcatcccaaagatgcccaggcttccaggtgcctgaaacctgcagggatcagtctaa

SEQ ID NO: 399 - DNA, 500 bp, Homo sapiens
agtaattatatctgcaaaggtgctatttccacataaaattatattcagaggtcccaggtaaacatgaatatttgggggacactattcattccaccacagggggtgatatgtgcaggggtatggtggtctatttgtctgaatgaagtccgtcactccccatcacttttaatgaggtcagtaattcccgaaaggggattttaaggaaaatttgggagcaaaagatcttagtagatgttatagtgtagaatgcggctttgggcatagtgagccttgatggaaaaagtatttcaataaaagagacggaagtttgtttgtgaaaattggaaaggtactggctgtacaccctgcagagccccggaaaaatgaacctcctcctcaccctcttttttatgttcttggtaaacagctctgactcaaaggaagaatatgctgccagccagggactatgtttacactgaagtccacatgggagtaacaaaaacctgctgggaggcttttgt

SEQ ID NO: 400 - DNA, 500 bp, Homo sapiens
agagtgaagtgcggatggaacaacagccactggaattgccgacgggtgcacggccaaacgcttggcaaagtgcgtggcgcgctgggattcccccacaaaaggcagtttaccaaaaaattattaagagaacccaggaaaattgaggccagttcaggcttgctcaggaagggacccatgtccaggaaagagagagcgatgctcttccctcgctcccggtcccccttccctgggccaccggcctttcccttccggcatcagccagagccaagtgttctgaacactacccccgcccccacgaaaagtgaggaccagatggcgccccaccctctgaatacctctcagcacggagtgtgaatcgccaccgacctggcgtgtgtcagtagctgcctgggagcggccaggatgggcgtgggagcacactcttgtgtatgtgaatgtgtgcgtatgtgagtaaataagtgtgtcagtgtgagattgtgtgtgagcacctgtgtgtctat

SEQ ID NO: 401 - DNA, 500 bp, Homo sapiens
tttccgtgcagtggattttgggcatagcatagcagtaaccgtgccgggctgatgagtaggccagcagttgaagtagtgtgcattcttttccagtgctggcagctgccgtgtttgctttccgagcagtgaacctgatggaggtgacatcactggctgcagctgaagtaaggataagtttcactcagatgggatggaaatagtttctgagagattgccaggctgtcattttagtgtctgttgcataggacacgcgttacttgtagccaggttttttaactcgggtaaaacctgttaagttctgagctaataatacttaaggattcaaatttctttaattacttgagaaaagtcttcttatgaaggagtaataaacaagattattataggaaaccattataaccatatgggaaaccagatacctggtaattttaatggaaacaattggggtttatgttgcatttttttatcgttcatgtccatgcattattttcacagaagaa

SEQ ID NO: 402 - DNA, 500 bp, Homo sapiens
cctgacgtggcccagagtggacggtggcccctacccaggcgcgcgcgtggccccagatcccgcgctgagtccctgcaccgcggccgccgcggcgctgctgtccccgagaggcagccctgtctctgctggcccgttaactgtgctggcagagctgttaccgtgacagtagattaatatctctttagtcagccaaaatgaacatggcatgctggtgacagtccaattttctgctaacagattgtggcctatcgaaacccggcgctcagctgatttttatttctgccagagataattcagcgcgggaggagcggccgccaccatcccatccaccagcgccgttcaatatatcccgcgccggcgtttctcacccactgtcaggaggctgcccgagggactccgagggcctgcggcatttagaggctgtctcagagcccagaggcacggctgctgctgcgatcaatgctgagcctggacttgcctgtttccaggcttgggggctg

SEQ ID NO: 403 - DNA, 500 bp, Homo sapiens
tctgcaggatgtgaagtgatagctgtgaatacccgctccacgagtcaaacctttatttataaatgcgacgcagttctctgtacccttcccctgggtgtgctgaagcagcagccaccagccgttcagtttgtgccacctctccctgagtggaaaacatctgcagtccaaaggatgggatttggcaaccttaacaaggtagcttgccctagacactcctgtctacagatctgatgtacaaatagcagtcttcgttgtttacttggtgaggaggtggccttgcatttttgggcatttggctatgctcccaattgtgacatcagggctgaggcgtgtcagttgattctcttcagtgcctaagtctatcatcaagtgtctgttcatatggacttagtcttatggggtcatttcacaaactcaggcctataaaaaggggatcgtaaatgtcatcctaaataataaggattgctgggcttattttgaaagcagattagaagagactt

SEQ ID NO: 404 - DNA, 500 bp, Homo sapiens
aactcttggtcctgccaacacagccgattgtgccaaggttctcagcatctactggcacatgaactgttgccttttctttggctttctgcatgtacctggggccatcatccttccttcacaaagcagcagtctggcttagttgtccctgagaaagacttcaggattggttggactcaactctggccctcttcaggttgtgcatcctgcacaatgtattttcagccacacaatgtattgttcaggatttgtcgtgcacatacttgcagattggcagagccaactgccagagatgagaaccttttaagttgttgtcaaacgtcataaaatgtgttccgtgattaattttgtgggcacagattggtttttgcacagagtccaaaatttaggatatgtcacagtgactaaatggcaccggcatgctgaatgaatttggaatttgttttgtcaagtgtgggagcaggcacacagatgggctttgatccagtggtgctgcttggaat

SEQ ID NO: 405 - DNA, 500 bp, Homo sapiens
aaggaaaaaactatgagcctaacctcttactacatttagactggctcagaatacacacagggaaactccttgattctatgacacgaagtgacagtagcaggaactgggattttaaatgagacacacatttgcaaaacaatcagaaaacatttattatactgaaatgtgtacatcctactattaaaaaaacaaagtaacaaatttgctggtgccaaaatttatttagcctgtttcactgggacaaactcacgttcaatgccactcagtataatttcaagtctgataagcatctaagtatttttaccccgcttctaaaacctgatgaggaattcaaaataagcacacagcattaaatgacatttattgttccataaatcttgagacccaaaaaggaatgctaaatagacaagcaaaacttttaaaacaaacgagataaactcacttctttccccagtgactggtacagaaaacatgtggtcacacgaaagcaaagggaaaaa

SEQ ID NO: 406 - DNA, 500 bp, Homo sapiens
tcttcactttcatgctttattgaaagtagaatatgaatcaaagacaggcattggtaagcaggttatgtctctaaaattacttttcgttcagagcagaatgttgtcccatctacttgatacaatcctttatggaccaacgcatctggtatgaaactcgagcaaggaaatataacagaactttattcccctcccacgactataaatctcatatgtaaacatgatttactattactgctactaaacttgttccgtctttacttgccccctcccacccaccaccccccttaaatataaaattggaaacatttccttcaagtctgatgtccatcagtgcaatctgctttatttgacataaggcatttgggacagtcacgtttgaatggatttctgccttttggaaggggcatgtaatggtttaattcttaaatccacctttgctttaatgccctaacatgtcaaactcctcttcccctctggtcatttcttagcagtcagcaagt

SEQ ID NO: 407 - DNA, 500 bp, Homo sapiens
tctaattcttcagggttctccagtggacagacagatttgcttatgttgtgagttaatgattaagaattcatgttgtatggaaaggaaaacaataggaacaatgacaattaaataacaccaggcatttcgtcagtgtttccaccagctccttgcaggaacgctccagtctgttggccaggggaagatttttattgtctcctctgtgtatttttcttcagttcctaaccaaccaaaccgctgtgtgtgtttcgcctttgtataaaaaacagagaatgcaggatagccttctatcctaagtgttttaaataaaatgggcaataaaataattattgaaactggtagaagaaaagaaggatttaggggaaaagaagcccacctactttgctttatgagatgtggaaactttcagagctgcctctgctttgcctctgaagagaaactaaagaaagaaaggaatcttttggaatgcaagataactaaattcatttgttatggtcttt

SEQ ID NO: 408 - DNA, 500 bp, Homo sapiens
ccggggctcagccctcatgcctgggaacagaggctgctttacggggtgagggcctggggccccccgagccttccccaggcaggcagcatctcggaaggagccctggtgggtttaattatggagccggcgctgaccggcgtccccgccctccccacgcagcctccttggtgcggtccaacacatcaccgggcaagctgaggcctgccccggacttggatgaatactcatgaggaataaaggggtgggccgcgggttttgttgttggattcagccagttgacagaactaagggagatgggaaaagcgaaaatgccaacaaacggcccgcatgttccccagcatcctcggctcctgcctcactagctgcggagcctctcccgctcggtccacgctgccgggcggccacgaccgtgacccttcccctcgggccgcccagatccatgcctcgtcccacgggacaccagttccctggcgtgtgcagaccccccggcgcctaccatg

SEQ ID NO: 409 - DNA, 500 bp, Homo sapiens; identical to SEQ ID NO: 243

SEQ ID NO: 410 - DNA, 500 bp, Homo sapiens
gcgcacggactgggcgcctctgccggcggcccctgctcctgcctcgcctgtcacagcggcccggccaacgggctggcgccccgggctgccgccgcctcggacttcacctgtgcctccacctcccgctcggactccttcctcaccttcgcgccctcggtgctcagcaaggcctcctccgtcgcgctggaccagagggaggaggtgcccctcactagataaggggccgccggctggctgccggctccatgacgcccgtggggtcaccccccggccccgggactcagccagcctcgctcctcgctcctcgctcctcgcccctaggacgccaagggggaaaggagagggcggaaaaggaccagcgggatccggccgcaagaattggaaagcctaggaagtggcggtggctggcgcgtttggggagcaggagtggggatagggaagcagagcttgagagaccttcctccggggcagcctccggacccaccgccccccaccagggt

SEQ ID NO: 411 - DNA, 500 bp, Homo sapiens
aataaccagagagaggctttgtagcctccaagggagcaaactgaggaatcccccttttgctttggctgctgggctgacccgagctggggtgcagaggtgggtgcggcagcgggcaagaagctgctgcccgaggcgtcccggctgaggtccaccgggtatccgtcgctgccggtctgctggcgttagtgaagaacaggcacatgcgtctggttgctgttttgttttatataacaaattgcttagggtccgcgaggtggaaggcagcctagagctgagctgcccggagggaggggctgcgggtagggggcagtccgggaccaagggaggccgggagaagggtgcgcatgccaaacctcctcctttgcacctctgagtcgggcacaaacatggattttttttttcaccaggtggtctctagcatgtccaaaggaagacaagaacggtttgtgcttttaaaagcgcgcctctactgtctccaagatctgaatggagtccccctc

SEQ ID NO: 412 - DNA, 500 bp, Homo sapiens
gcaggttgagtccatccaggcatctgtaaatgagatgcttgggggcccaaatggctggcagtgtgtgtgtgtgtgtgtgtgtgtgtgtgtgtgtgtgtgtgtgtcaggggcttaccatgacatgtttgtgccattcagaagaacggaattgttttctacccatttgaacccagtcggggcgtggtgtcagttcagaccaagaccccattgggtgtcgggtcgcatagggggtctgattatggagtctttcggtgggatcaagcaggaggccctgcttgcagctcccagccagctgccccgtaaagccttaagtccctggcccaagaagccgcagggcttagaaaatgcggagcggctgcaatccacgggcccatcctccactctgcacaagagatctctgccagccccagcactggggctattctgtccccaccaaaagcaaggagatctggcaagctgcatttttctttatttgacatttacaccctgccttcttgcag

SEQ ID NO: 413 - DNA, 500 bp, Homo sapiens
ggcggccgccctaaacctgccggaaaccaccatcaaggtatgcggggtccaggctggggaggcgggtgtgcacctatttagcgggaagtaaatgccaactgccaactccctgaaacgcaggccaggaatctgggcctggggtctccctgcccggcgcgtgcagattgaccctcgtgacagctcctaggcaggcattgctgccatgtggctgactctgtccctttcctggttaaatagacaaggggtgggcgtgggggaaggggatagagtgcctgtgcgggtgacaaggaagtttctggggacacgctctctgcggccgcagaccaattgagtccatgtcctttcactgctcctcccatacacacactggcctctggcaccccgggggcctggccacctgggcagaaggaaggagggagcgggctggagtcactccccaaacctctctcggagggattccagctccaggtggtggtggtggggtcggtctctacccggct

SEQ ID NO: 414 - DNA, 500 bp, Homo sapiens
ccaacgggcgccactacgggattaagcctgaaacccgagcggccccggcccccgccacggccgcctccaccacctcctcctcctccacttccttatcctcctcctccaaacggactgagtgctccgtggcccgggagtcccaggggagcagcggccccgagttctcgtgcaactcgttcctgcaggagaaggcggcagcggcgacggggggaaccgggcctggggcagggatcggggccgcgactgggacgggcggctcgtcggagccctcagcttgcagcgaccacccgatcccaggctgttcgctgaaggaggaggagaagcagcattcgcagccgcagcagcagcaacttgacccaagtaagtgcaaaagaaattgccccctgatttattgctgaaacctgtaaggctcgaatgtgcaaaactgatagttttactaacctataaaaacgtctagacgcctacccaagcctaggcgaacaacatgcatccataaaaag

SEQ ID NO: 415 - DNA, 500 bp, Homo sapiens
atgcggtcgcgtctgtggtcctggcagccgctgggcgggccaggccaggtcgggccgggccgagccgggcacatggacctgggcctgcgggctctaattgcggcgcttatgttgatgattttttttttaatcacagcagcccccagtttagcggactgatttactcccggtattggtaaatatgatcacgtgggccgcgcgaccaatggtggaggctgcagcctgcgaactagtcggtggctcgggcgccggcggggagctgctcggcggcggacagtgtaatgttgggtgggagtgcgggacgcctcaaaatgtcttccagtggcaccctcagcaactactacgtggactcgcttataggccatgagggcgacgaggtgttcgcggcgcgcttcgggccgccggggccaggcgcgcagggccggcctgcaggtgtggctgatggcccggccgccaccgccgccgagttcgcctcgtgtagttttgcccccagatcggcc

SEQ ID NO: 416 - DNA, 500 bp, Homo sapiens
atagcattcggcagtggacaaggagtaggcggacccgaacctgaacctgacagctgatgccgtgaagtggacacttgaagttcttggtttggctttagggagcgtttagggaatgtgttaggcagcaatcgggcaagcatgagctgtagcccaacccttccctccgtgggaaaattcaagttaggacgcaatgcgaggcctcttaaatctttaagatcctcgggtcagctcaaagagtctttagcaattcgttgttttgtcttgagaccattatcggtccctaagcacctaattatttaatggcagccctctgggtatatcgggtagactgataggtcttatctaacattcaaacacaagtttctggaggaaactctcatctgacttcctcctttcccacccgccgcccactgtcatttattttattaaatggaacccatttaaaatccaaatttataattattaaaaagcagtcttattacatattcttgaagatttgg

SEQ ID NO: 417 - DNA, 500 bp, Homo sapiens
agttgacagcttggaaaaggaagcgaaacaaaggtccctgggaaagtgaagttttcaattaatttggtgtgagaaacgggcgggagtgggtggtgactgcaaaatgcgaggccggtcggctgctggagagacacagaagtttcacggtgggaggctgagtggctttctcccccggcgccgttctcagggtctttctgcgggtcgaagaaggacccgcgggagctgagaggcccaggtcggaagcactcccggctggcccaagagtagaggcgaagagcgttgagtaggcatccatggacttttctttctgggacagattgtcaggctcactgcgccgatgcctgtctttcatctgtttaagtctctgccgccagccccaagggcgcttcatgggcattttccgaacggacagcgtgtgtgtataggaagggtctgctccaatgcctcttacctgtgtgaaatgcctttgccgggtaccagtgcacaaggtagggcaaatt

SEQ ID NO: 418 - DNA, 500 bp, Homo sapiens
acctaaccccttgaagtcagaccgtttctctgggctgctcctatcacaaaatccgaatttgcttggaacaagcgccctcttaatttgcccctctcagttctctgcagttgacagcttggaaaaggaagcgaaacaaaggtccctgggaaagtgaagttttcaattaatttggtgtgagaaacgggcgggagtgggtggtgactgcaaaatgcgaggccggtcggctgctggagagacacagaagtttcacggtgggaggctgagtggctttctcccccggcgccgttctcagggtctttctgcgggtcgaagaaggacccgcgggagctgagaggcccaggtcggaagcactcccggctggcccaagagtagaggcgaagagcgttgagtaggcatccatggacttttctttctgggacagattgtcaggctcactgcgccgatgcctgtctttcatctgtttaagtctctgccgccagccccaagggcgcttcatgggc

SEQ ID NO: 419 - DNA, 500 bp, Homo sapiens
cctttaagctttttttcttattcgcatcttctggcttctctcttccgtcgaacccttttggcaaccgcagggaacacgcatcctcaggttggcacgggaggcggcgaggagctcccggagccaccggctgctggatccccctctcccccgcgtctgggcggaggaggaagggaaccgggtcgcgcgtccccctgcgacagctctgaaggctcgagtccctgcagagcgtggacaccagccgtcttctcccgcccacggcgttacacccgtctcggctgctccgaagagacccctcgctgccatcgcagaaaggctgggccaaccctgagggccctctcgcctggccgtccctcctcgggtgcgaaattaggggaggagggtgtcggggtgtgcatctccaggctgcggagctcccgggcatgaaagccagggccgaacccgagaaagcagaagtgcacgagttcgaagtggccactcggccagcactccacagagctgac

SEQ ID NO: 420 - DNA, 500 bp, Homo sapiens
ctgatgcctgcaaattatcctggatcactaactctgatcacttacaaataagaaacttgagtgattgttattttatttggagtgtttgtattttgtaattatttctctactacagtacaatgacctttgaggtcattctttgatcggggtaaaaaacattccccattgaaaagcaggcacctggatagtggcttctaggccctgccaggtagattcggagcaggaagagtccctaggtcggatggtacccgggtgggtgtgggggtgtggccctgatggccaagctctatgttcagagcttcagtgcttttccctggttctgtagcacagcgcgcttgagtgactaaaaacctgggttgggtgcaggtccgattacgcagcagaggttgatgtcatgggcagatttggaagacttgaggggttctttgtaagccccgtggtagcattaattcttattggaacgaaatggtcgattgcatctaagggaaataatccacaaa

SEQ ID NO: 421 - DNA, 500 bp, Homo sapiens
gcgctcagggccggggtggcccgggggacggaggagagataggagagcccgccctgggtctcagagggtgctgttgcgtgctgcaggttctaagggaaaagggctttcccctggcaggagagccaaaggcggggaagggagaaggaggggcgggagaatgaggaccagaagccggagaagggaggctggaggaagacgcaagtggcccctccgacctagtggacggcgagttgaggtacagttaatgcccgggccaaggagacaactgtcgccgccttggtgacggatgccccctccctgggcccccgccctagtccccatggggggagcagcgcgccagaagggagtaggcgttgttgggaccctctgggggtctggaatgccagcgacacttctcttcccagccgcaggggccttcctgggacaggccaggtagaccccacccccccgaccccgttcgtcagggcaacaggttgggtgcaagctgtcaagagatggcc

SEQ ID NO: 422 - DNA, 500 bp, Homo sapiens
tgccccctgatttattgctgaaacctgtaaggctcgaatgtgcaaaactgatagttttactaacctataaaaacgtctagacgcctacccaagcctaggcgaacaacatgcatccataaaaagagcttcccataaccacctaccctgggcgctcagttagtacggtaaacagagcgcgagcattaaggctttttatgataattccccacaagttgtgaaaagcgaccatccttggtgaaattaatttaacgacctctcttccccaccctgtggtctctccctgcctcccctcctctcctctctccccgtctccaaacctccctctttgtagacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggt

SEQ ID NO: 423 - DNA, 500 bp, Homo sapiens
gagggggcggatgcaagtcctggacttgggggattcgaagctcaccccaagcacccagtgtttcaactgctcggggaatgcttcaattgctcggggaagacactttccccaggcgagggcaagatcaaacgccgatccgggcagtttgtggctggcagggtgtaagaggcatggaggcgcggaagccaggagtccataaaggaccgtaaaattgcggcccacttgggcagcccgggtgctgcagccctccgaccagtttgcacgtcggtcagaggtccaaattaccttgtcacttcccgggcttcgcggcgccaggtcggaaatggtcccaatggtctaattgcctttggtctccggttgcatttgaaaaggcagagatcgggtcctccccccttcccctttccttcctagtcccacttctccacccaaaggaaaaggagctgcagggggctggagccccacccttctcagaggtaggcccaaaggggggctggtttaac

SEQ ID NO: 424 - DNA, 500 bp, Homo sapiens
taaatagtaaaggaaaagaaatgggaattaaagtttgcaaaccaagaccagggaaaagtcggctccagaagttaccaggaacccacccaaacctgtgcactcatatctcctgtatttacatattatagacaacttttcctttccacttttagctagaaaagtggtgggctccccttagttcgtctcgttttatgctgtaagacccaaagtctgctgagggctgcccctgccaggtaacttccggagacccggagttacttggagacagacccggccctttgcacattccaagtgaaggacgtctcgcgcattcttcccagagctaccacacacctaacctcttctggacacccaacagctggggcactggagcacctgaccctactcaagatcatcccccagcccttgccggcacttagggacagcagaatctgagctgtgggtgtacatactccccattttctgctttcccagaggatcacagacaacttttcttccca

SEQ ID NO: 425 - DNA, 500 bp, Homo sapiens
tctctttctcaggacctaaaaagtgacggggagagggtgaagaattggagaaagcagcggattttcaaaacgtatcccccccgcccccccatcttttaaagtagtatgttaccacaaggagtgcatttgggaaactttccctaacaggagctgggcgcagtgttattcttctccatgggtctgctggcctccccgcccccgctggacaatgcgtgctttgagactcggtggcctgcaggcagcgggagacgaggggactgggcagccttcctccaaggggcccgcagctgggggagcgccaggcagggagcagggacaaggaggcgagccacgcaggaaggaaaaccataaaagtgccattttttcccttagccctgcacagaggcaggctttgaggacctaggggcagggcagctggggcggggtggggtgggggtgttgagaggttttgcgtgttctttttaccccctttccccccactgaaacattttatttcggca

SEQ ID NO: 426 - DNA, 500 bp, Homo sapiens
tgcttatcccagtctctctcattccaaaaggctggtccagcctctcccagccccactccaccctccttttcatttatcttatttgttctgtcattccccatagcttcttccaatgtaacctttccaaactctgattagtagaagcttcattctcttcactcacgcttttcccccaagccccctctctccctttctctctccttcttaaaagattttggagccgggaagataagatatgcaatcctctatcgggaatcctgtgatattaaagatcaaacgtagcatcaatggaagaccaaatgcagggggaaacaaaagggggaggctgggagatgctcatcagctaattacagctgcaaatattatgcaaatttatcttggcacagaaatggagaaagcgagtttaagtgcggagataatgccggaaaattgaatgttcatctgggcatgggaaacggcccagtaggctccattggtctgtttcatctagggaagcaccg

SEQ ID NO: 427 - DNA, 500 bp, Homo sapiens
tggaggaagaacaatgaagatctaattgtggagatttcataagttggctcccgtaaatgaacagcttagatatggaagttccagcagatgtgggtactattcgcctctacaagctctaccccccacccccatatacgcagtccaaacactctattggagggttttttttttttttttttttttgtggtggtggtggtcctcagatcctagcaaccacctaaagtttccagtagtaattagagcttttatcgggcttgctcttcagccctttatattgccgatttagcgttaaggcattaagtccacacaccaaattagcgcgactcccaaatagccacaaccacttattctccccttccctcattttggtggttggacaccaagagcatgggcctgggacttttttttttttttttttttttggttttactttgttttgatttgatttttaaaacctattcgctaccgcactgtcttggaatatacttgtttcaggcaga

SEQ ID NO: 428 - DNA, 500 bp, Homo sapiens
cagcggcatccttagagaccctggggacaaaataaatgggtctcccaccagttgaatgacaagtatcatcagatcggaaacgaggctcagtttctggatgctgagtggactgtgcgtgcgggaatattttaagacggcatcgtatgtcttgcttggcaattaaaatagttgaaaaagttgctcaagaaaattcgaagggttttgtgttctgctttcacttcagaagttatcgggcagtgagttgcggcgcgaagccttaagctttcacttcacaacttaggcatggttgaaaagggctacccacccccacccaccatcccactcccgccaactcccccccccacacacacactctctctctctcccaacctttagtccaaatcgaagcccgcaaacctcaagtatatgtacatttatttcccttcagatgaaaataaagacatcggcctcatttaaaagcaaacagggaaaacagttccaccggcgccctttgacactgt

SEQ ID NO: 429 - DNA, 500 bp, Homo sapiens
ggcctccggggcccgtgggaacacacacaccacccgcgccatcccgagagaaattgcaactcatccattttttcgcggcacttttctccgacgtctttttgcttttttttttttttttttttttttgtctttttggagggcagagtggggtccggaaaagcaaacacaaaaccaacccggagtgggaagtgggaggagggggctgcgcaggtgtgaggtccgcggcgcggtgagctggggcttgcgagccggggccccgcgtgcgtcctccgcgcccgcgcccgcgcccttccccgctccggccgccggcccgcgtggtgcggcggggcggtcagctgttgtactggcacgcgttgaggcccgaggccgggccctgcaggccgccgtagccaaacgacgagtgctgtttggacttgagccgcaggctggctaggctcgagttgcacgtgtcccggtagacgctgtagggcgaggcgggagtgccgtacgggcaagcgccc

SEQ ID NO: 430 - DNA, 500 bp, Homo sapiens
aaaaagctttacacatgaatctttttcagttttccgaacttccccatatgaattcctttctttatgattttctagaacagcaaaacacagtagtcccaaaaaagagagtaagagagagcagcccatctaatagagtgtcccggaggccagcgccagcgggtgctgtaaggagcccggcggcggcaggtgggaattgattgagctggctgcacttgtgtaccaggatgcagagttctccaggtagctggacgctggggactggttggaggtcggagggtgggcatgagggtggtggctgagcgagcgggacgagccctggggctcccacaccgctggagactgcggcgagttacacgccattgggtcgctggagctgggactgtgctccgggggcatctccccgtttttcatgatcttcttgatcttggatcttttgttctgaaaccagattttcacctgagttggggaacaaaggcacacgttaccgggacactcagagg

SEQ ID NO: 431 - DNA, 500 bp, Homo sapiens
agctgaggcgaggccgtggcccccgcagaccgcggagacctcgccggcggccggcgcggaggtgtctgcccccgccgggcttgaaggcacttgttggtaaaagacacagacgtgtcggtgtttgcctctcccggggaagggcgaaacgctctgaagttctctggcgctcttctcaggagatgattcggcctcccctcctaccctggggcgccctcggggtctcactgccgcggaggaagaaggcagcgccgccctcgcctgcagaaacctcattcccgagaaagtgcgggacgagcgtcttgggatgtggaagaagggggtcgccaggaggttttcttaagaactcaaaacaagcgccccccaccgcacacgcacacacacacacacacacacacacaccccttcccttgggtggtctgaagagtcaaagtcccagcttgaccactttcccaggacaaatggctttgctctctgggcctcagtggcttcagttgtaaaat

SEQ ID NO: 432 - DNA, 500 bp, Homo sapiens
ttgtgaaaagcgaccatccttggtgaaattaatttaacgacctctcttccccaccctgtggtctctccctgcctcccctcctctcctctctccccgtctccaaacctccctctttgtagacaaccccgccgcgaactggatccacgctcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttag

SEQ ID NO: 433 - DNA, 500 bp, Homo sapiens
agacagcaagaaatgtccagctggcagcatttgcccctgtctgatcattaaattggaaaacagctgtatttttattaagccctttggattttctttttaaaacctgagtctctttggcagtcaaatttccttccatcaaggcatcttcccttaaaggtagaattggggtgatggggagatgtgtgtaggccatcagatttcacaacccctcatcaaggagtcactttggacccgagaaaagcaagtgcccgcgtcagcagaaaaggaacgaggagcgaggccgccagatcgacgggaaacaggcggagagagggtcgtcggcgctcagggccggggtggcccgggggacggaggagagataggagagcccgccctgggtctcagagggtgctgttgcgtgctgcaggttctaagggaaaagggctttcccctggcaggagagccaaaggcggggaagggagaaggaggggcgggagaatgaggaccagaagccggagaag

SEQ ID NO: 434 - DNA, 500 bp, Homo sapiens
cataagttggctcccgtaaatgaacagcttagatatggaagttccagcagatgtgggtactattcgcctctacaagctctaccccccacccccatatacgcagtccaaacactctattggagggttttttttttttttttttttttgtggtggtggtggtcctcagatcctagcaaccacctaaagtttccagtagtaattagagcttttatcgggcttgctcttcagccctttatattgccgatttagcgttaaggcattaagtccacacaccaaattagcgcgactcccaaatagccacaaccacttattctccccttccctcattttggtggttggacaccaagagcatgggcctgggacttttttttttttttttttttttggttttactttgttttgatttgatttttaaaacctattcgctaccgcactgtcttggaatatacttgtttcaggcagagttttgcaagggacctgagccattattttgcaaacgc

SEQ ID NO: 435 - DNA, 500 bp, Homo sapiens
gcaccgcaggggtcaccaaccatctccgccacgcgctactcgggggaaggaaatcgcgctttaaaatacaaaaatctgtagttttaatatgatttcctttattacccagattgtaactgaagaattgcaacgcagcgcttctgtctgggaaaggcagctgcggcagcaacagctggagtagtgcaagcgggaatctgaggctcagtaaaagtttgtaagagttgagatctagctatcagaaagcggcagcggcatccttagagaccctggggacaaaataaatgggtctcccaccagttgaatgacaagtatcatcagatcggaaacgaggctcagtttctggatgctgagtggactgtgcgtgcgggaatattttaagacggcatcgtatgtcttgcttggcaattaaaatagttgaaaaagttgctcaagaaaattcgaagggttttgtgttctgctttcacttcagaagttatcgggcagtgagttgcggcgcgaag

SEQ ID NO: 436 - DNA, 500 bp, Homo sapiens
gggtgatggatgagactgttgtctatctgaatggaaacctgctttcataggaagggtggaggtgggagaggaccagtgaagggcagagctctaaaattctggcaactagagtgaatataccctttcctcctttcatccttcttcctttgctccctccctccctcgcttcctttttgctacgtctctttttggtagatcactgtagttaaccttcgttctggccaagaccaagaagggttaatggacacccggctcctgacaccttccaggtcagcttggcttgcgaacttccaacgcaggaattggaggattaccggggaaggaatgcgaggtacccgatagcctcacacctgaacacggtcgcttcaatccactgggattcatttaaaaaaaaaaaaaaaagaaattctcttctggaaaatggttaattggatctgcagctacatttcctgttgcaccgaagagccaagcagggcagcctggattggatccctcaagct

SEQ ID NO: 437 - DNA, 500 bp, Homo sapiens
caagacatcgtcttttaaataaataaaagtattctcaatatcattcgttttttattttcaaacctaaaagctgggcttcttttccttttctctccttttctttttctttctttatcattagctttctgccctaagtgtgcgctaataaagagctaagttgctagttcaagtgtgtttaacctgatggagcaaacacccagcagcaaccggtcgcgctcgcggctgatagcgccgcgacctctgcgcgtccgccccggccggttcccattctcaagtgcctggaccctgtcacttccacctgtcccagtcccagccgtgagaccagagcaggtgactgttcagcagcccctagagttcccgacaccctctgacgggatgtctgagctgtcgctggcccaagagaaaagaggcctccaacaagttggcggagctgccctagctacccgcccccaccccacctctcgcctttccctctcctcctgaaattcgttttcttgggg

SEQ ID NO: 438 - DNA, 500 bp, Homo sapiens
ttatttattgccggggctatataatagagataatgaccacaaactcaagataaattcttatgcgcccagccggtcaattcttttttatttaagagagtgagcctgaagggtgagcctcatcccctcccctcctcgaagatccgtcttgctttctaccatattataagcatgacatgcaaataaataagtgctgctgggtctgtgtgggtaggccggcaggatttatttcaggtgacggaggaacatacacggaatatgaatttccgcaggagtggcgccgtgattccttccctctccctctcggccgccctctcctcagggtctccctccttttctgtgggagcagagagcatcccctgttaaaaacattaacgtgtcatgtctcagctccctattccttgacatataggtctggggagggatgggggcactgcaaaatgcaaaacgcatgcccaaagtaggttgacttgctgggactgctcaaagcgattctggtggac

SEQ ID NO: 439 - DNA, 500 bp, Homo sapiens
tggttttggtcttaaatttctccttttagtcgaaattcttccgatctctttgagatcttctgagtccagagtgagcagtgtaaccaggcggcagactccagctgacccttgttcttgttctaggtcctgcatccttacattcatcgggactgaccagaccttagtgttctctcttttccttccttcatcctctttctctgcctcagatccgtcgtctctcggtcggtctcagcgggtcgctgactacctcgccctagcactcggtccgcgccccgggaaggcttcagcatcaccctcttctgctgggatcccgctgaccctgtctgcagcttcggcttctcttgctcccagagcggggtcttcggcttgccgcggatacttagtggcccaaaacacctaaaattgactcttcctgcgctcttgagaatgccaagagcacccagtacctgcaaccgccggcatgagtggggcctgcggggagccgccagagctgcggacag

SEQ ID NO: 440 - DNA, 500 bp, Homo sapiens
gtatatagctatgtggagccctgaagcaattctccatgcttttgtctccctcaagttccccaggtggaggcagtcataagcattataagccgccttagtgaccaccagggacggaaaccgttaattatcacgtttcctttcatctccaggggccctttggcccgtgacacaagaggcttcggtattggcgctttcccagaactggcccagaggagccagttcagagtgtgaggtcgggtctgcattgaacgtacacaccgaggtctatcagactcccccgattttagcgaagggtgctgactgctgtgctgctagaggctagcaagctccctgtgcgcagctgatgagtttcagcaactcgccacctgggcgcttttctttaaattttgggagtaaactgggaaaataaaaaaatctccacgtccactggctctctccccttctccaacttcctctttcgactcgtttgtgggagttttctcctctttgctgggactata

SEQ ID NO: 441 - DNA, 500 bp, Homo sapiens
cacagctattagtggccgatgtagctatgagctccgggctcccacttcctcttctcttaccctgttctggggcacagattctgaggtaacccccagtgaagcctgacacctcactcccgactcacgctttcccagggctcttcaatcccggccagccggcagggcctgggagcgcggtccagcgcccagcccagattcgcccagttgggcaaggctggccaccccgcagcccgagtgtgcaccggcccccggcaattgctggcttgttagcgtgtgattgattgccttattaaagcgtgttcttgtaagtgtgaccaaactgattgcattgcatatgtttgggataatgctcattttaaacaacaggataaagaggatgagctccgcagagccttgaagacaaaatgattctggctagcagctccctaactatggcattaaattgctcagttacatagcaaatcgctacttggtttctgcatccttgtccgtattttttt

SEQ ID NO: 442 - DNA, 500 bp, Homo sapiens
gggcacagaaacaccatgaagattattttcccgattctaagtaatccagtcttcaggcgcaccgttaaactcctgctctgtttactgtggattggatattctcaaggaaccacacatgtattaagatttggtaagattccccatctctcttggttgcctggtatccgctcccaggcagccggatgtaaacaggcggttcgctctgcctggcggtgggctccgtggattctgatctgctcactgctctgtcgtctcctggggcttttaaagaactccttgtgctttcatttcttctcttctttatttttatttttagccgcgggagggtgaagggagggccaatgtgtggtagtggtctctgcattacctccccacagtagcttgccacggagatgatgatgacgatggaggcacggtcagccgccactcccgcctgtctcccccggcgccctgcgagcttggaggggtgcgcggtccgcgcaaaagtgcgcgccggggct

SEQ ID NO: 443 - DNA, 500 bp, Homo sapiens
ccccaaacaatggtggtctctggggctgtgtggagcctacgccggcccaggagaaaccagcctcccgtaaacaccggcggcgagttgtagaaaagtccctccagggtcccagccctttgaaaaggtgtgtccctccccttcctcgctctccccagagcaacgtctgggaagccgacactttaaaggcgcactccttttcaggaaatctccgggtgcttcctggtggcccccgggggaagctttgctagccgcctgcccctgttcccggaaacgaggcctgctgggcggactggcagtgcgtccaccgcgaggacaacactgaaggcgctgctggcctcgttcgcggtggggcccgccccgaccccgcgctccactccggccacgcctaggtggctgcggaggccgtgtccctcctccacttctcagaccctcgccgagcaactgacgcgacccggaggctgaggaagacggaaagtccggggccaggtcccacgtctgtg

SEQ ID NO: 444 - DNA, 500 bp, Homo sapiens
gtatgctataagaaatacacttacaatatgaaatgttctccaaattagattgtgaggttctttaaggataggacgaaagacagctagacattctcgatcgcccagttttagaaagatgaaatcattttccacgtggagggcagtgaaagagaggagctaagttatcaagcgccctcctcgcttctgctgagctgtggctgatgccctggccatggaccccctcagccgctgtgtgtgcgcctctcaacacgcacggctgactccagcggcacgcctgctcctcggcccttgtgtctagtgagtacgactgagaatgcgtctcctctcgtcagtaatcgctttcatcgtgccactactttacagaaagtctttccggcatatgcagtggaaggccacggacctcctcatcctgctctttagggtccatccatcttcactgtgcaaagcaatggtccttctgggtgagttagacaaagtcaaaagagctgggttccagcttg

SEQ ID NO: 445 - DNA, 500 bp, Homo sapiens
ctcctcgtaggagtcgcgcccagcaccaccttcctcctcctcgtcgccctcctcctcactaaactggtagaagcccagcgggctgacctgcgtggcggccgagatgcgggctatctgggcccgcaggtagttggcctcgttgcccgggaagggtgggtagctgacgactggcgtgtccaggtagcctgtgaagaacttcttgatctttcgggcgttcacgatctgggctggagtgacgtggggcagccgcgtccatggcaggcccggctcgttgcacacaaagtacaggtacttgttggcgcctgagcggctctcctccttggggatcacgggcggcggcttccatacggacttagggacgatgtccacggccttctcctcgtcctcctcgccctcctcctcgccgtgcgcctccatgacctcgccaccttccgtcatctcctccacctcctcctcctctgcctcctcctcgccctcccggaattccacctcggccacca

SEQ ID NO: 446 - DNA, 500 bp, Homo sapiens
acagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggagggactcaggatcattgttatcagtgggccaaagtta

SEQ ID NO: 447 - DNA, 500 bp, Homo sapiens
agaacaaggagaagccctctccgggcaccgggccacagtcaatggcactctcctacccagcgagcaggccgggtccgccagtgtccagcttccaggcgagttccacccagtctcagaagctgagctctgctgtactgtggagcaagcagaagaaatcatcgggctggaagccacaggtttcgcctcaggtgatcagctagaagcatttaactgcatcccagtggacagtgctgtggcagtagagtgtgacgaacaagttctgggagaatttgaagagttctcccgaaggatctatgcactgaatgaaaacgtatccagcttccgccggccgcgcaggagttccgataagtgaagtgagcaggtcaacagtaggactggggcagaagctctgcctaaaatgaagtgaaagctgcacttaaccctttgtgataatgatgacacaaaatgaatattaatggaggatattcctcggaaaaacagactttgggaatgaaggaggg

SEQ ID NO: 448 - DNA, 500 bp, Homo sapiens
gaggaggcgggtcaaggagacttgtccacccaggcgtggccgaggaaggggtttcctcacgctctgctgacctgccttccttccatgcctctcagcccagctcctgacaaaggcgggaacctgagctcctcggctttaggaacgtcccccagagcccacggagcagcccgccccagctgccttccctcccaagatctccaggtaatgcctggtaaaaggagggctccagggagaatgttggggccaacacgcaaagcgcgtcaccttccaaccggcggagagtgaaggaaaacaggtacggctcggcttgtaaccttcactggaaacagaaaccatcctcatcattgatacctggtgaactgcacagagagcaacctgcagctttggaagtttataaatccttcagtatttgtcagctgccagtaaacaaaaatgcacacaggagaactttccacctgaaccccacctggaggccggcgttcccaggtcccggctggggt

SEQ ID NO: 449 - DNA, 500 bp, Homo sapiens
agtgtccgggacagttgagggggtgatgggacagattcagctcccaacgtgagaccaactgcacaggtgcacattggggcgactctgcctgccatgcagctccgtgcacatccgaatgactgcgttatttccttgcacagaaaacagcctttctcctgggctgacacctgtgccctgggcctgtggacgccctgtccaggcagcatgcctccttggttatccaaacagtaagaagaaatgcaggaacttcgtgatccacacgcgtgtggatgaccctggcacacagcgttcccgttaaattctaagtgtggataagacggcacaccggaccactctttccagagcctctccttgcggctgctaataatgaaatacatcttagatggctttttaaacatagcatttagggtatttgtttctcctttcaaaagagaagaatcccttcccaaagtaggcgagccggaaaggcccagcctggccactttccgcatgagtggcca

SEQ ID NO: 450 - DNA, 500 bp, Homo sapiens; identical to SEQ ID NO: 241

SEQ ID NO: 451 - DNA, 500 bp, Homo sapiens
tcaagtatcagtttcaatcttggtttctattcttatggaaacaacgttgcggtttccgtatactcgaccgtgcatggccactttgggtccagaagggaaaaatccaatttctagagctcatttgtcagtttgcttagcacagacagcactctgggatgggtcactgagacgccgccactctggagtgcagcctggtggcttttaagaggagacacccggcgaaatgctctccagagccaaagaacgttccggctggagcgacctgggaggaagaacgagccgactgctggcccactccagcctccctgtctcggcctctgtccacacgtgggtgagggggtgggagctcctgtgtggcccacagcccgctgctgggggtcctcagtggccaccccgggcacctgcatggcactaggcacagcggcttttctgccttagctccatttcctttgagaagtttcctccaaaagccatgggggacatccccctcccagggatct

SEQ ID NO: 452 - DNA, 500 bp, Homo sapiens
gggattaaagctcttttcctggcgatgcccgagacccctgctatgctctgctgcagcccccggaacagtattggcacaggtgagggccacgcctcctccctgggcccaggcatcaggcgctggctctccacaggaggccgcagcttaaggagctcacagacgtttctattcggagagaggggaaggaacgaagacaggaacacagcaccgtttttagtaccaggagacagcgacagcttggcgtcagtgcgatgcgtgacatttccgtgtgtaaggtgtgctgctgcctggtggagtggcgcgcgagcacctggctgctttcctccctgccagatgccatttcaggaaatcgcctttgttgctcaggcattcatacccctgactgctcaggcgcagcctggcttgggattcaggagggctgaggggcctctctgagctcccctggtgcctggaaggactcttcagggtcctagcccctggcctgccatgagggccatcat

SEQ ID NO: 453 - DNA, 500 bp, Homo sapiens
tgaagatcgaggacccagctgggagctcaggtgtcggggccgcaccatagacgcggccgctgatgcagcacttgttgaaggtcaagatgttctgcgtgagcgtgcccgtcttgtccgagaagatgtattccacctggcccaggtggtcgttgaggctggtgctgcgggccttggcaggcacgtcctgcggcttgtagtacatctgcacgtcccagtcgatgaagacgctgttccccaggtagatgaactcggacctgcagaggcactcagggtcacggtcagccccgcctgctgtgtgccatccccatgcctccccgttccgcgtttgcaccggggacgcagccggcggagactcacaggatgaacatggacatcgggatggtgacgctgagcaggatgaggaagctccagaagacgaagaaggactctgcggccacgctgctcccatgcacccccgagaggtagtagtggtggtctttgaattctttgactgagaaacc

SEQ ID NO: 454 - DNA, 500 bp, Homo sapiens; identical to SEQ ID NO: 244

SEQ ID NO: 455 - DNA, 500 bp, Homo sapiens
aaggctgttgtcttattgcattaccagcgcccccccccaccaccccaccccctgactcacccactgggcatctgatggaaggagaggttgttggcttccagtaatgttgaactggagtccctagagagctgaggccatagacaggcaagtggagatggctgacttccaaggcaggtttccttctgctaaagtgagtcttgtcctgtctgtatgtgtgcaggtacacacacacacacacacacgcgcgcgcgcacacctgggaggctggctaacacttactctctatgtggctggggaagtaagaactatgcattatgcaaagctcttggggtgttggagattgctgaggcagatctcaggtcccagagtccccccaactaccctgggccagtcagtgttgtctaactccttcaagtgtcaggttgtctgaagtgctgaaatcaactagaagcctgtgtacagcacccttggttgccggatgggtctgagtgttggtgatg

SEQ ID NO: 456 - DNA, 500 bp, Homo sapiens
gttctgcttttcagatgttagtggaaaatatcatagaataatgcagtaattaaaacggtttcctcctatttcctatcttaaataggagattatttaaaatatttacacatcttttttatttttagaatattcagtacaagtaacactgaattatttcatgccttctgtatttttcatgtgcacacatcttactagattgccacatcaaatcagttcctgtttatgttgagcgagctgggtttgtaactgcgagctgtttcaactccagttttgctgattctttgttgtgaatagctgtggtttatctcaagaatcctgtaagattctgtatatggaagaatggtgagtcatctagagttgcagaatagcccttttgggccccacagcagtccagtttcagtccagttttcctgttcattcccccttgcctctagcaagaggcttttacaacccaggctctgggtaccaagtgttacaggtacatgtttataggcgtttga

SEQ ID NO: 457 - DNA, 500 bp, Homo sapiens
aaaatttttgtactagaaaatgtcactttcaattaggggaggggaaattctgattggggatcagaagagtcaagatgtattagtgataatttggcatcacttttgattcaaggtaaaaacacagaatccctaaaaatgtagtaaagtaaaaagtgattcatataactagataggggaaaggaaatgtcactgctgagctttactgtgggaagagggggaggtgaaggaaattattacaaaatttttgtacgtgatgaggagacagcctctggacttccccaaatatttccgtattccctaaaacagctctagtgaattgcttcatgattggtgtatgaatagaaagacactagaactcttaaacttgatcttgaaaggcccgtctttgtatataatcatccacagatgtccgtatgtgattatatattcccatagtgaggcaatgataaatgtaaatgagaaccatgatataattttgccttgcttgcatgcacattttc

SEQ ID NO: 458 - DNA, 500 bp, Homo sapiens
catgaatggatccagcagaaaaaaagaaaaaaaatcactaattcactggcagtctgttggtttgtatttcactaatgtacagggtttgtggtttataacgtcatcagagttgtacaacagcattatatccctgggagctgtgcaggtatctctctctttctctttctgttctttgcatacaatgggggatctaagcctggattcatgccctacccaggacatttcctttttgtggcatgtgagcagagccgttaccaacgctaagatttactgctttggggatcggttcagaacaaatgttccaaacagccgtctgcctctggcaaggtaattttggacaaattcaacaagacttcaaaggaagccacctactacaatgcctaaggaggataaagacctgatttaaatgaatgtattgcaattagtgggtatttactttatatgttgccaagttctgatagctttctctaaccctcagggaaataatatgtatgtctact

SEQ ID NO: 459 - DNA, 500 bp, Homo sapiens
tcttcatatatatttcttcttatttcttcaaatatttcttcatatatttctacatatatgtatggcatatatgtatggcatatatgtacatgtatgaatcttatttcttcatacatgtaccaggcagtttccatttaatcctcacaacagacttatcctcatattacagatagaacattgaggctctgagggtttgtgacttacccccaggtcatgctctggtcattgataaatccttgagaagtttaccgtgggtatctaaaagatatgttaatcatataaagtcaatttcttcccccaaccttatccttacgctttttggacaatttccttgagcaattcagcctaaggaaacttgaaggcagggtttggcatctagccagggtacagcagccgtgccagcacagcagcctccggtcaagggttgtaagtcattaacttgggtctcctaccacttccggttaagaatgcaacactcaggtgagaacttctcaggtgga

SEQ ID NO: 460 - DNA, 500 bp, Homo sapiens
aagaattgttatctttttatttatacctattttccccctgtacttgtattgctagtgatagaagttctgaattacggatacattcttaggcttaaagagtacacattttttcccttagagttatagatgatctaatctaaaaagttggaggacttaaaaagaaagtgtgaagatttttttttcttcatttcctgatttgcttctttaaggaagtgcgagaaggttaaagatgtctgtgatctggccaaacgaggttcacaaatgctgttttcatatttgtggttttggtgtttcctcttacacatgtgtcttccttcttcagtttctcagtctgtcgagagagcatggctgcaccctgtgcattctgggcacacatcatctgggctcagtgcgggctttgtttatagcagaagccataatgtataatgttcaggagtgggtgagctacctaagaaactccctttgaaggattccttgtgtggactgcttatcagaaaaag

SEQ ID NO: 461 - DNA, 500 bp, Homo sapiens
ccttctctctgatctttggccggcccggttccatctcccctctcccctccatcctaggatgtccctattcagctctgccctccttcccacggggcagttggacctttctccattcacttctccctgcagtttctccctagaacacaaacccaccccaccccctccaccaccccaggctccctatcccttctccccagaaaaactgcaagtgctctcaccctggtgaccctgccctcactgattcaagctcgtcactttaggctctcccactggatgggctggggcaggtcacactcaggaaaggaaggaaagaaaagggggttggaaactcagagcccaagggaagggagaatgagcagcctggcacaccctgaaagagacacacccagagacagcctttgctggggcaggatcttttgggctcaaaatggaaaaggagggctctgagaaggaagggtgtatgtgcagagcgaggaagggtggtggcaggaattaacaag

SEQ ID NO: 462 - DNA, 500 bp, Homo sapiens
aagagagcttttgtattaagtttctgccaacaaaaaactccttaatgggtgcattctttgcctcggcatgtgaataccagaaaccctgcaatatgttcgtgaatgccttttacacagacaaccagactgcaagggtctattaaattatgctccaaatgttgtgcagctaacaatggaggtattcaggcattttaaaagagagagggaagtcacaggggacggcccattaggaggaacaggatgtcgacacggcctgaaaatgagttcctttgtaataggaaatgcattacaatgcctggagattcacttctcccaggcttccagcccacagttcttcctgctgggctcaggttacccactgtctcactgttaccagtatcaccgcatcattcaactggataacattcagcattcatactgctttccaacaactaacttgatgtcctaaaataactcctagatgtttttaaattataaagcaatgctggaattcctgtcta

SEQ ID NO: 463 - DNA, 500 bp, Homo sapiens
ggataagcatctattacttatctctattcattttgactcaggcctgtgtaaaagcaggaaatagaaggcatgagtgttccccataatatttgcagttcataagttagaaattagcaatcagccccttttcacgtaggacacaataatagacactctggcacagtccctgcaatttggttatgcgaagaaaacaggaaacaagcacattttcactgtggtttcagtctgaggagggctggcatctgctgacgtgacggctagattttcttgtcaatatcgtatttactatcctgatcacatgagcggagagaggaggatgagtcacagttaactggctgctaaattaggaaaatgtaatccatttatttctttcaaattagattcccccaaagcattttagacctttttttcctcagcaaccatagccacaacctaaacagctaacacattcccaaactaggctaatctggctgtctattatagctagacaatctggctgt

SEQ ID NO: 464 - DNA, 500 bp, Homo sapiens
ggtaaggggttgatgggattaactgaaaggctaatgactgtctcaaaagcacatgctgttgctagggaacccaagctcctgctgctctctaatcaccagcgtgttccgtggaaatcaaactgctcagggtgttattaaaatgaatggcatcgggttaaaggcattcttgcttatgttgtagcatcctggattattatcgattgcctcacacccacatatcttgttttcctaatttgatttctgtatttgcgtcactgccagggacactcagactagaccagtcagttcacttcctgtttctcagaactggtttatatttggtctcgtagcactagctggtaaaacattatcaaactgatcctcttggaaagaaatctttgcttcccattgaaaacaaaatattccaattaaattgtaattcctgtggaaaacgtcatcatttgaggagtagactgccagttgccatttgagaaacaatccttgaaatgtaaagcctagaa

SEQ ID NO: 465 - DNA, 500 bp, Homo sapiens
agcccaacccatgttctcagcagcagggatggttctaggctggctgaatgagggaccagggcagagactgcaaaagcttgagagccaagggggcagcacagagcggggaggggctgggcttgggctgtgctcctgttgggtttccattaaccaggggaccagctgggctgctgtgatttcactttcgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcaggtgaggcccaggggtgctggtggaggctggggcagtggggacccctggagatgtctcacctcccttccaggaaatggaaaccctgggcagcaggcagctcaggtg

SEQ ID NO: 466 - DNA, 500 bp, Homo sapiens
acgtgctaacaatttctatagttccagctctgacatcactcttgcttagagtctaacgggagagtttcagcttccaagaactttctttactatcataggaaatgacacagtttctctccctcccccttactccctttctttttctttctttgaactcaatttccttaaaaacagtgattttatcattttactaacgggctagaagccagggacttcccagatgtacaatgaataatattctctttctcccggaggtcaaaatcttcgccgcctgaggttttatgtatttgactcctccagacagtcatttctctttttaatgcctactctgttccaggagctttatgtacaataaagccactgcatacctacagtaagctgcaaggtagctattgtttccccattttattaatgacagaagtgaagctcggaggtattcagtagtgtgcagatatctgtctgtactggcacagtttaaaaagaggcacattcaaaccaga

SEQ ID NO: 467 - DNA, 500 bp, Homo sapiens
gaccacattccttttgttaacaagctccatcctaaagtgtccttggcttattcttaaaatgtaacattttgctttgtaacacaaacctgaggaaacaagatatcatctcagaaaactttcattgcattttttggattccacgttttgtcaagctctcatttgatttataaccaaccccaggttacttccccacggtttccagctagtctgtttccagctttcctctgctcgtggtccacatgaactcaccgtgaagaccatctgtgcttgacacatccacccatgagcagcgtgtttccagtgctcattttcattagcagctcctcacgtcaagtcagtttacataaactcgactgatatattcttggatggctatgccatcaggatgtgcacatttttatacataatgaaaacacagttttttttcttgggcactgggagtaaggatatgttcagtcagtttgtagtatgagaaagaaatagatggtcacagattctat

SEQ ID NO: 468 - DNA, 500 bp, Homo sapiens
ccaaaaagcaaattacaccggctgtggaggcagagtactgctgttgcagttttgcacaattttaatctctttctcaatgcatgcccgggctcgtgtatttaccagtgttggtcaagggtatattagcaatgttcagtattttttcccccacaggagtgtttagcacactaagcacgttgcgttggttgcaattcatcttaggccttattactgaatgtaaaatgccttcatctcttgggggaaaaggtgcggtgaaaatgcaaatcatcatttagctaaaactgaacagctgttacaagagtccataattgcagaactattgcaccactttcatcttggcaccaggatgggtgaatgagtgagtaaaaaagcccctcagttcacaagacgacagactattttcttttctacctatgttaattttccatttccctccctagcaacaccagccccacaccatcttctgtgaaacatgtcaaaatggccttaagcctggaaga

SEQ ID NO: 469 - DNA, 500 bp, Homo sapiens
tatgcctaattagatgtaatgcgtctttcttttgagaatgtaggttcatggtctcgtggaaccagttcctcctggtttaaacagagttattgaaatgcaggaaggatgctggatgtctgtgcttcttttttctgaaaggaacctctcagtccctgggtgaccctgtgctaatgagtctccactggtgagtcatctcccggcctggactcagagatgctatcagtttcattgaagtccccacagtcacctcggcttctccagcctgcaacagctacaggaaggccattagctcagccgtgtgccctccctccccacaccaccccaacttgtccctcctctaatgtaatatttgcagacatgcctggcattcgttcctaaaatgtattattctacacacaaacaccctttgatcagcttgacaggaaaaccagaagcatcacgtacatatttggtttagcaaagctgtaacgggaacagatgtctctgcaaagactatttca

SEQ ID NO: 470 - DNA, 500 bp, Homo sapiens
ggctgacgagcttggctcagaagccgctcactattgtttgggctttgcttttgacttcacatcctgaaataaatggtcgttgcagaccaggcacgtgagcaggaagtgggcagggcttaaaacacagagaagtcataacctctgcggtttggttcatgttgtaatatgaaaaccaggaagcttatcttgcaggaggctgatgtgtaaaagttcagaatggagtggagccctccctcttggcaccctatgcgcggagtcaccctttgtctgccacaggaagcacccaggtcctggcagctagaaaactgtaacaacttggaaacatttcccaaaatgtcatcatggcatcaaaatgagacaatcaatttcttgcaaaattgtttgcaagaatacaatttgatcaaaagtagagttagacttttttttttttaagacagtttcgatcttgttacctaggctagagtgcaatggtgatctctgcttactgcaacctctgcctg

SEQ ID NO: 471 - DNA, 500 bp, Homo sapiens
ccctggtgtataaactacgagactgttggcaagggctgtttatcccatattattgccaaagaaaacaaagcacccatcctattgggctacatgggaaatggctttcattaataaaaaaataaaaataaaaaccgggagcctcctcctccccccaccaatcgtctgtggcaaatggagaagtatcgatgcccttcccccttctgattctatttacggctaggtttttaaaagcagcaataaaacaaatgtcgactctttgggggtttactgggtgaacatgttccggctgtttgtgctgctttcggccagtgttcttgggctgctctgttgcagccaacagatgtgtgctgctgcaggggatgaaagaaatggcactaaaaggcatcaccatctatcccttctatttctctgaagactttaacagggtttataccgttttataaattattgaagctaaactctcaaagtgtttattgaaattctttgttgaagaacaataa

SEQ ID NO: 472 - DNA, 500 bp, Homo sapiens
aaaccttagcgtgtggggccagcacaggtcagttttttaagagcctccgtagaacagggtcttatttttgttcctgagctgaaatgcacacatgcacttagcagagaaggtttgcctaatctatcaccggttttcgtctgtttctgggtttccattaccttttgtcagacgttttctccaagatcctcgctgctttctttttaatcacctaagaagcaacattgatgtgacaagctccagaaaaaggctcgtcctttcttatctgcatcttcagcctaatgatgaggaatgggttccataaacttgaaaaaggcaggaaaatgctgccaaagtcattatccactactttaaattggaaagaaaaaagctgtccctttttagaagaatggtaataacgtataaaataattgtacaaagcctacagcgtttcatataagaaaggaaattgcccaatgcaatttaaaagaaaaacaaaataccttcatttcccgctatctgaa

SEQ ID NO: 473 - DNA, 500 bp, Homo sapiens
tgttatttttcattagagaattgctatattaagaggctgcgatccagctgtgtttgtttaaataaaagtgtgatttgaatacctcctacagctaatgttcctgccaatgaataaaagataaaaatgcggctctcgttggatgggagtctctgcgttctagctgactcggagatttattgttccacataaggaagttgaaagcgtggagggcagaccacacgcagcggccttttgtgtattgtttcaagccgtatcactaatagatttcttccaccgaggctcccagcaattcagctgtgctcaaatgctccacttaactgtgaaaaaaaataataataaaatagtaattatgcctaaatggcaaatgcagcccagctcaatgccacaaggaagaaagtaaacaggaacaaatactattcagagaagaaatgctgtattttaatgctggtgataatggatttaagcctcatttttctttcaaagactcctctcactcatat

SEQ ID NO: 474 - DNA, 500 bp, Homo sapiens
cggcttcaaaatggccctcagcctggagccaagatttaggagcaagaccgtctagttgggagagaagatgtttttggagagttgaagacttcttgaaaaagttcgaaaagttcttgaaaaagcaaaggatgcttctttccgtctgggagagggaaaacctctcccagggcaaaaggaactaagaccaggggtgggttaaaaaaaaaaaaaaaaaaacctttcactcttgtagaataagccaggagccggcgtgtggtagacttctgggcctgtttcccgacagctggtttcgtttagatttttgtgtgattaactgacatcttcctgttcctttgccacatgtatctagcaagcctcttttaccttataagggaaatcctttgtagcgtgtggaaggctttgattgcaggaaggggtggaacccaaaatgactcggccgtgactagcagtttttcaaaaatacatatatatgtatgcatgtacagatatgcgtgtatctc

SEQ ID NO: 475 - DNA, 500 bp, Homo sapiens
aggtggatagttaaggaaactgtagatctgctgaaagctcctcgtggtctgtggtctcgtgtccacgctgacctttgaacctcgtaactcttcgggtctccagcggccacctcttttaggctagcccgaatgtttgactttccggtcctcaatcttcctcacctagctgcagaccataaaactgtctttttatttacagggagatgttaaatatttgggaacatctgctcaggctgccaggttattttccgtttgaaagcatgccgatttgacatttgcaagttggtttatgttgcttcctttttgtttcactaagaacgcttttcataccaagatctgcgaaaaacgatgcccttagactgttatttagtttattgtctctgagtaaggccaaattccacagagggtctttggataatggcaactttgcttataagaagataatttttctagaaagtgttgcattggtctggtttcctaagctgttcttgtggtcatgt

SEQ ID NO: 476 - DNA, 500 bp, Homo sapiens
cttgctgagccaggcaactagggggacccttcgctgtggaaaaattggtgctgcgggaaaggcaagactcactcccttgcaggaaacaaagaccccttaggagagagaaatgttcatggaatgaatgaataaacaagtttgacctactgctctcttccttttggggacttgggagaaattgggcagggcatagaggaaagggctgggtgtgatcgcagtttttgctttcaatgttttactgaggaaatccgtacaactgcctatttccgccgcacgtgaggcttcgggtgccctcgcctgcaccagtgtttatgattgacaagcgaggtcccgatttcccccatcacactcctgtgttccctaccccaaaccttctactctgttcaggccagtcttccctaccgcaaaccttctactctgttcaggccagtcttaaataatagccattcttgctttggtgtccaatctcctctcatccccttaaatgccgctgtcatgca

SEQ ID NO: 477 - DNA, 500 bp, Homo sapiens; identical to SEQ ID NO: 265

SEQ ID NO: 478 - DNA, 500 bp, Homo sapiens
gagctgtctcccaggcaacgcgtcccagtgcatcgggagctctttccagatgaggctctgaatctgcaacttagcagaagaggcgttctctgctgtttttatggggggtacttatcacattttcacagacaacataaacataattttaagtatcaaacatctttaatgtctttattcctcaggaagtgacagtaaatgcccctctattaagggctgtttcctgtaaggcggagataaaaccaataagcgcggtttacttcttaggcgcgagcatcaatctcagccgcccatccttcctttagagctaatttagagttattgcacctcgagcgaggccgtccaaattgagcttaattcacattccagcttcaaaaacaaggtctgtgtctcgctgtttccctattgttatatgggctctcatttctgtgcttttgatcccaaattctaagaactccctttagaaagccttgctgggaaggtggtttggtggggaccaggtt

SEQ ID NO: 479 - DNA, 500 bp, Homo sapiens
cggggtacggtcattgtatctccagataaaaaacattctcttaccaaggaggcctctgaaaatagcaggctgcaatttcagttcgacaccacggggtattaaaaagaaaagtgttacttcacctcgtctctttataaagtcagcacactgtgaggctgtggcattcctcgacaaatcctctttcaggaccctttcgggaatgagaagaggggagtggtgggcactgcattgattgtgacggggccagcccggccgtgggtacgtgtggcatgctctccagcgagtgacactgatttacagcaggataacaggaagtgtggagcttgggtggcctgctgtgtaattctgggtgacagattgcccctgccacttacaaaaacggtgctataattaatccaaacaggccaacaataataaacaacgaaaaaataatatctttatacaaaatatgggattgacctttagtatgattctttttcaccttaatttttttttctttt

SEQ ID NO: 480 - DNA, 500 bp, Homo sapiens
catttgttttggcattcgctgaattctagagatgaaaacaatctcctgcttttaattcagtccacgtgcaacaaagttgtacgttgggagatctggcttttaataagaacgattaacaagcgtttttgatcacaggaagttgagaagagtcgctgcttctaagaatacaataaacattgactagcagttagacggtccatctttctctatcagccgtttagcagcctctactttgatttggggcaaatgcgagatgggaccaggagagagctccccacacccccaccaccacgtgggcagtggttctgttccagagcgccttccttcctgtccagggaggcaggctgctgaggccgtttctgggcaagaggccattgtcgggatatttgctttagatagcttgcagctgggctgagtgggtgtttcattcagactcaacacaggcagctcccaccgtctctactgtttcaggctagtggaagctaggggccttttgattt

SEQ ID NO: 481 - DNA, 500 bp, Homo sapiens
agccacgcctgggaacagggcctggtctgcctctacttgctgggtgcagatacttctctgcttacagccaggaaatggggagggtgctgcgggcggcagcagggatgtggtccgccctcctcatccttccaacgctgtaaatcatctgtttgttctttctttggagtcttcttgcacaatggctctcgccacgcctctctggcctaggcaccattacatcaccctgggtgcatccggactttctagcaacggctttgtttacttgattgagtaaagagaagttggccttttttaacttttaaattagaccttgcgcctttcttgtgggaagtgttttctcttatgtttgtagaatctaggatgggtgttttgtgttttcggttttgatttttttttgagatggggtctctgtcacccaagctggagtgcaggggcacaatcttggctcactgcaacctccgcctcccgggctcaagcgattcccctgcctcccgggtagc

SEQ ID NO: 482 - DNA, 500 bp, Homo sapiens
acacagacaagttgcccggcagcggagaaaacccgtttagccttgtagtgctgaaaccggagatgaatgagatctaatacagccccaaagcactgggtaaagaaaagcatcacaacttttggggggttgttggtccgggaaggcagcggaggaagctgtgagtccttgggccctggaaggagcgcagcctctgagacactccgctccagcccggcttagcgcgccttcatattcatcatcaaaataagacggttagaatcttgcagcagtgaggcggccaatcaaaaggacagaaatgttatccttgaggtgcagagacagccaataacaaatgccttccctaccgaaactccctgatgaattgagcctggcggagaatgtattattgaacattaccatagatcagcacattgcatttatcttgtgattacagccaaccatacctaatgctggggagataggctgacaaaattgattgcttaatgtgtctccatttatta

SEQ ID NO: 483 - DNA, 500 bp, Homo sapiens
cagccaggaaatggggagggtgctgcgggcggcagcagggatgtggtccgccctcctcatccttccaacgctgtaaatcatctgtttgttctttctttggagtcttcttgcacaatggctctcgccacgcctctctggcctaggcaccattacatcaccctgggtgcatccggactttctagcaacggctttgtttacttgattgagtaaagagaagttggccttttttaacttttaaattagaccttgcgcctttcttgtgggaagtgttttctcttatgtttgtagaatctaggatgggtgttttgtgttttcggttttgatttttttttgagatggggtctctgtcacccaagctggagtgcaggggcacaatcttggctcactgcaacctccgcctcccgggctcaagcgattcccctgcctcccgggtagctgggaccataggcacttgccaccacacccagctattttttgtatttttggtagagacgggggtt

SEQ ID NO: 484 - DNA, 500 bp, Homo sapiens
ggcggaggggaggccacctccagcaggaacgcagagcgggtttccagagcacaggtagcactgatcagctagaactgaaaagggcattgctgagtagaagcacctcttccctcctaccttgcggtttccccatgacccgccctaaccctcataaaaggatctctgctgcaagagcctcccaacccagggccttccctgccacccccggctcacaccaccgcccaccgcaggcacacttagtcctgtccacgccagacactcaatttcctgtccctggcttgtggaagggcctagccgcctttccatccctggtaaccggtttctctctgtcatctcttctttctcagtccccgacttcctcacctaaattccctccaggcccagtccttagaagctgtaaataaaatgtgccggaaagaaatcaggaccatcgtgggggattcctgagccttccttctgtttacttcctttttccaccaaacccttggaggctcgggctc

SEQ ID NO: 485 - DNA, 500 bp, Homo sapiens
cgcgtcccagtgcatcgggagctctttccagatgaggctctgaatctgcaacttagcagaagaggcgttctctgctgtttttatggggggtacttatcacattttcacagacaacataaacataattttaagtatcaaacatctttaatgtctttattcctcaggaagtgacagtaaatgcccctctattaagggctgtttcctgtaaggcggagataaaaccaataagcgcggtttacttcttaggcgcgagcatcaatctcagccgcccatccttcctttagagctaatttagagttattgcacctcgagcgaggccgtccaaattgagcttaattcacattccagcttcaaaaacaaggtctgtgtctcgctgtttccctattgttatatgggctctcatttctgtgcttttgatcccaaattctaagaactccctttagaaagccttgctgggaaggtggtttggtggggaccaggttctggaaggacaggtcggc

SEQ ID NO: 486 - DNA, 500 bp, Homo sapiens
aagcttttcttggcagttgtctgcaaattgattcaagatgcccagccaggcaggggcaggtgtgctggggaaatcaaggaaaccaacatccatcctgctgggaaggcctcccacactctgactcatctggttttccttcacacgtgtatttgcgggaaacgaacttctgtgcttgaataaatatgcggttctttgtaaacatcaacgttgtaagtgcaataaatcactggaaacaagaggcacctctcgcggtggagaacaggaacggctttcgcaagcactatcggaaagaagcagcgacatcaataaagccgcccgtcagagctgaggaaagaaatcaaagcccttcctgtggaggacactgtttaattgatgtcgcattcaggggattatggactatgatcaatgcaaactggactgaccgagagaaccctgagcacggaaggttagctgggtgtcccgggctcccagccaaccatgtcagagccagaatggacacc

SEQ ID NO: 487 - DNA, 500 bp, Homo sapiens; identical to SEQ ID NO: 266

SEQ ID NO: 488 - DNA, 500 bp, Homo sapiens
aaggggggaggaaggcagtgagtgcatctgaattttttttttttttttacaaaaagtggcttattgcatttttctgattactctatcagcacgtgcagaccttttcctattcagagaaagcctgaagatataaagaggaaagtgaagaaaaaccaccggaaatcccatccccgccccagcatctggcactgtgtgggcgatcacgaaatgagcgcttgtttttgaaggcgtagtatctccgtgaacatccggttgaacaacctttctgactttatttttcccacgaaagttattaattaaaaaacaaaaagcaaaacaccgaaaaaacaaaaaacccagcaagtgtttgagctcccaccacgagggaggcctgacgtcactggatcctcccggcagccgatgaggctgcatgggacttgcccacgatgtgctgttaccgagtggcatagccaggcttcaaaccagagtcctagctaaccgccctgtatataccatgggct

SEQ ID NO: 489 - DNA, 500 bp, Homo sapiens
ctggcacaggtcctgccactgtccccaacctgggtttcaacacagctgaggcctggcatagtctttctgggcgcctctggctggctcggtctgaaaggtgggacagatgcaactggggcctccccgggtgcagcgtgggtggctcctggctggggaagtgagaagccctccgtgcggtgtctctgaagcagccccaggccaaggctgtggcgtgcttggtggtgctgtaggcccaagatgtttatgggtcgagggtccccggggccgggattctgatccctggtgagaggtggctgggaggaagtccagacgtgtcctgagtggccattcctcacactgaggtgacaccgcctctccaaacacgtgacgtggctggaagcagatgctgctgtccggttctccctcctctccgtccctggctgggacatgtggatctcacccgcagccactttcttctggcctctgtccccctgcctgggacacgtggacctcacccccag

SEQ ID NO: 490 - DNA, 500 bp, Homo sapiens; identical to SEQ ID NO: 267

SEQ ID NO: 491 - DNA, 500 bp, Homo sapiens
cctaagattgggcatccggaaggatggcccaacaccgtgccaccctgcagctttgccgcaagctgccctgggtcctgcatcctcttcgaggtggaatgagaacacagccgagagctcaggatcttccaactgctgcccacagtggcaaaaagaaacctggtgggagaagatgagtcagacggagccaggagcccgcggccggtgacgccagcggtgggggaacacaatgtcctgtgggtgatcggtgagcgagcggacggtggatttctcctgcagtcggtggcaggaaggatgtcatcacgcgctattttgtgaccagcccctggaccacaactcacgtgagcagaagggctttcttctttgcttaagatgtctgtgcttgcaaacttactggccacaggtacaaggaggttttctttgcttatgttcatattaaacatgttaataaaggtttttcttattgtccttgtttttacatttataaattactcataagctga

SEQ ID NO: 492 - DNA, 500 bp, Homo sapiens
aggaatagaccacgatgttacatccggtgggtctttgccacaattggaggctctacgttatgtacaagagcataattactaattatcataattataagtcttatgttcttctaagcaaaacaaatagctcgtatctctacagcgtttctcagctttgatctggtgaagtttcctttgtgggctcaggtcaggcggagtgagtggagcccagggcggctgctgcgttagaaatccgggtgcagcagatggcgccctttcctcagctatctcgccccagagctgggaggtggtgccacaggctgccgattcttcgcggttcttcaggcaaaggaaaaggagctgctggagttaaaataccagtgactttctagtctctgttaagaagtgctaacgagctgcgaatggggagaccgaaggagggagcggaaagaggaggaaggaagaaaactgctgcgggttgtgtgtctaaaaattctcacacagtttttcatttaatccgt

SEQ ID NO: 493 - DNA, 500 bp, Homo sapiens; identical to SEQ ID NO: 280

SEQ ID NO: 494 - DNA, 500 bp, Homo sapiens
aaaggctgactctttgatgagttgctggagagtcgttgacagttggctgggtttaccaccttcacgaccacgaaatctgaactagtctgatttgggagtgggggacacccccgctgttatttaactgccaggagactgcacttgcctgaaatgagatcatccaccgtgtctctgaaatcttgcagattgaagtctgcttccgtttggtgggaatggttctgaaaaaaaccagaggtgtacactggttaacgagtctggcgttagaaagccttcaataaatattggcgtccctgttaaaaatctggcaggcactatgcaatatatgcacgtaacacaactgcacttgtacccctaagtccccccaaataaaacaatttttgtggcgggtccggaaccctttctagaccaacagacctcctcccgggctcggcggcggtctgctcgcacttacgtcgccagcccagtctcgtacccgaaaattcaagccccatccgagacag

SEQ ID NO: 495 - DNA, 500 bp, Homo sapiens
ccatcccgcaccctcccgcagtgtccagggcgaacccctgtccccaagcccaggcttaggagtgaaatctcgacggctcaggttccttctctacgcagtcccccagccagactaggaatggatcaccgcgcgggtgggctcagttcccggcttcgcccgggtctaggaagaatgataaaaagtgagaatgtaaagggaggaggtactataaaacaaaaggggttagacacccatcaggcagctgcgacccggtggtaaacatgagcgtctcctgtgctcccaccgcctgcgttcttcccggccgcgtccacgttggtttccttctcgttgtcttggtctctcctgattctgttctcgtgtcagtctgccctgcctctgttactccaaatctctgtggtctctctccctctctaccttctctgtctccttctgaatctgaatatggctcagtgcttctggctttctctttgtctctgaagctatctctctgagaatgtctc

SEQ ID NO: 496 - DNA, 500 bp, Homo sapiens
cagcaccttggccctgcaggtcatggcccactcacatggggagcaactcagaaccacagtcactgtctgtgcagggcagagcccccgggggcaagagggaaagctccgcaaacggcaggaccgcctctttgtagcttcctgcagcggcacagtctgtccaccgcgctccggagttccacaggaaatggaacgctccacagatgccagttacgcccgaaaacgacacagaacacaggtgcggacagggaacggcatcctcagagcatggtcaggggagaaaagcaagctggaaggagagatgattccatctgtataaaatccaggaaacgaaggacgctcaccgccatgcgcctcggtgtgaggagggaggcgtgtgtgagagggaggggatgtgtgtgagagggagggggcgtgtgtgagagggaggggcgtgtgtgagagggaaggggcgtgtgtgagagggaggggcgtgtgtgagagggagggggtgtgtgtgagac

SEQ ID NO: 497 - DNA, 500 bp, Homo sapiens
ctccctcgctttctttctttccttcctcctcctcttccccggcggcccctccctccttccctcctccctcgctcgcctccctttctggggatgggagccccgcccacatcctcccctccagccgcccgacctcgcctagcaggcccgggtcccggaagcccaggcagcgcccgagtccgcagctgccgtcggagctgggacgccgctgcctccagctctgggaagcggctggggctcacctggggaccacgtgcggaggtactagaaagcatgcaccgactagtcgccgtaccttccaaaaatacccatgggagtctgggcttccctgagtttagtgtaactgctgcccaaactgatgattaaaacactgagtaatcaccatttaccctgagtaattagagataatgaaacacctctaaaatcaggttatggagaaaggagctgttggatcggtttaaaaggtggccttccataaactgttaaaagatttccaaacgttg

SEQ ID NO: 498 - DNA, 500 bp, Homo sapiens
aatatatcattggctaatgtgtgtggttttctttttaaataatgctaagcattggaataattaaagagtgagaaataactcgtctctcctctctcctctccattcagcattgtcttatttaagggcggaaagcgcgcttttcggcagagctggttagtttttaatgcgggctttttttttctcacccgccgttccctccgctccggtctgattcgcaaatccccaaactggcacaaaccgggaaacttgcggccggccgttcttctccccgagttggagacagccctctcctcttccctcccccgcctctgggccctgacccactgcctggtttgcgctagagccgtttaaaaaagaaagaaaggaagaaaggagccgggctctggtaccccgatgccagccgagggcgcgtttcccaggcggcgggctggtgggagagtcaaacccgggtgtggggaagcagcttcgctgcctactctgcatcctctcccctaaaaaga

SEQ ID NO: 499 - DNA, 500 bp, Homo sapiens
gagatctgcctgccgaagactcgcgggggcgccagggcggggacgcgcctactgaggacgactactgggggggctacgggggtgaggaccagcgaggggagcagatgtgccccggcgctgcctgccaggcgcccccggactcccgaggccctgcgctctcggccgggctccccagccctctgctttgcctcctgctcctggtgccccaccacctctgactgcggtgctgagatcgaagaggccagtgtccgatccccgcttcccgtccacccggggctgcggctccggccccagtcgccccaccttccctggccttgctgcctccctttcccctcccagctcctctcctccccggggagcaggccgcctctccttgcctgccccctgggctgtcctgacttgtggcagccccaagagggcgtgtgtggtggctcagccctgccctccccagttctggccattaactcttccccatcccaaggctggggtggggcccccca

SEQ ID NO: 500 - DNA, 500 bp, Homo sapiens
atcacagatcctaccaacgtgtgatgtctcccccggacgcccagctttaaaatttctctcttttgtactctgtccctttatttctcaagccagtcgatgcttaggaaaatagaaaagaacctacgtgattatcggggcaggtcccccgataacccccagctgcagatcgaggcctagtgcgagcacaggtccccccagacccttcccagtgcccaccaaccggcggcctaggccaggtagaactggcagcgcctcccctgctgcaacaccaggctctggtagaaacttcagaaaacatgcaccggcaaaaccaaggaagggtggctgcgtcccgggttcttccgcgcagctgtgtgtacacgcatgcacacacccacacgcacacacccacgtgcacacccccatgcacacgcacccacttgcacgcccatgcacgcacacacgcgcgtgcacccatgcgcacgcacccatgcacacacacgcgcgcacacacccacgtg

SEQ ID NO: 501 - DNA, 500 bp, Homo sapiens
catacccctccctgtgggcgtcgggttgcactgttgactaacttagaaagcgagatttctaaaaatgatgctggggctgcaggctgcgggctgcgggctgcgggctgcgggctgctgccgcggcgggggcttccggcggcgctctcttctgggtcccccacccctggaccagcgaccgacgaccagccagacagccctttcctgcgaatggacaatgggagaggctggcgcaaccgagaatagccagcgcggaggaagggctccggacggagctaggagggtggggctcggagggcgcaggaagagcggctctgcgaggaaagggaaaggagaggccgcttctgggaagggacccgcacgacgacgcccgaagggcgtcgggggaagtggtaggccccggagactgcgcgaggctcctcagcaaaggaagtgggcgcggcgcgcacgcaagacctcgcacccggcctcgcgcgccgcctctggacagcccagcgcctctc

SEQ ID NO: 502 - DNA, 500 bp, Homo sapiens
cccaggagggctgcgctaggtctctcctctggctccccctcctcgggtcctcgtggctctctgtcgtgtgaagcggggggtcaggagcgcacaaatgtttatactccacgtgagtcacttgcacagatgacgggtgatgttttcctcgccaaggctgatggcaccgggcccctttgccgttccagcctcagtcacgcctccagtctgttagcatttagagttgctgaactttcgcattggtcaggggcgcgggcagcttgctgaccttttctgggagtcgtggcggacggagtggagccgtctgtctcgtcacagacaggcggggctgcggctggggatggccgccgcccactcgccctcagaatggccctcagcggggcttcctgacccctcagccccggtaggaagctggtgtgcactgcagggagaggcggcagctggaaaagtgttaaggccacagtggtttttccagaggctcgtctggaatgccgtggctggat

SEQ ID NO: 503 - DNA, 500 bp, Homo sapiens; identical to SEQ ID NO: 276

SEQ ID NO: 504 - DNA, 500 bp, Homo sapiens; identical to SEQ ID NO: 198

SEQ ID NO: 505 - DNA, 500 bp, Homo sapiens
tgttgaagaattagtggactcctagacaaagaataatcccactatctcctagttctgactgatttaactgttaaacgtatattaaattcaaatctccaaattgtctctgtttcatcaacaggttgctcgtgggggccccgcgggcagaagcgcttccactgcagagagccaacagaacgggagggctgtacagctgcgacatcaccgcccgggggccatgcacgcggatcgagtttgataacgatggtgcgttcctttccctcactcagcgttcactccggcagcttgcctgtactgtttccatgagggaggagagtggggacaaacatttattcttgtagagaggacttcttttaattgcatcagacttgactgttttttatttgccctgaaaatatttacttactttacttctgaatcatactgggatgccgcgtgttttgctgctcctcctaaccgtggtttctaaaccgatatggtgtagggatgttgccacctag

SEQ ID NO: 506 - DNA, 500 bp, Homo sapiens
gaccaaggcggctggggaagcgcgggctggtgtgggggatggggctgaggcgaggggagggaccggagggagaaggggagctcggcggtggcgggaggagggcagcctccccccaccccccaacgccctccctctcctgctcccaggcgtcacgaaagtccaggaaaattatgctaatgaggacaaacggctctcacaaaggggctctcttgctgggctctatttcttaggaattcgtttgagaaacttcgtattcctctgccctggacacttccaattgtggggtgaggggaaagagaaccaagaaaagtgagtttcccagactttgcccagtttacttcacctgcaactcccaaacagatctttgggtgggggtgtggggagctgggataaggcttttctctagagaccctcaagagccaactgggctctctttggttaaattttcaggcagaaactgctgacatcctagcagccaggagaaaaatgtcctgggagag

SEQ ID NO: 507 - DNA, 500 bp, Homo sapiens
gacgggttttatgctcagtcattaccttttagtggcccacatgaaattttgttaaaggaagaaatgaaaagattttccccagtcagtctttcctctatttaattacaaaatgctggtgggaactgctgcatctgggatgcaagaaaatgcagaaagggtgactgaaaattttgcaaatgaacatgacttcccatgaagtctaatgttccattcgctgccatggtccaggggactcccaccagcttccaccggcttcaacaggatctccactagagagcccagacttatctagtcctgtcggggaaaagggagaagaggccttgcaggagaaagctaacagaaaattcgttacctgaggtcctgcctgcagtttcaaatagcttccagcagttttacaaaacacatcctttccatttcttccttttaaatgtttccctaagaacgatccatttaggtgctataagtcctcagccagggagtctctgggacactggcattca

SEQ ID NO: 508 - DNA, 500 bp, Homo sapiens
gacaccgaaaacaaataggggaaaccaccccctaaaggccacccagctgtggaggcttcacctatccaagtaccagctcacatggagctgagcgcacagtggtctcacttcctcccatccaggcctccaattcctaccttccaggcctccgacccctgcaccatgttgcaccagctgaagcccctgccgcccaccgctcggtggaggatggtggggagaacccttcccctaaacgcctcataaactgcccggctgcgctggaagcccggccaccttttactgctcagctcgattacacaccataaacccgacctcacaatggaattgccccggaaattctcctgtaaattgtagagtttagttccttgtgtactgagcacttcccatcactttcagagggtccaggccgtccccgtttaccgcaccctctcagggggccccaggaatacaaaaggtggagggagggttcagatcgggacgccacggagccccagttcctg

SEQ ID NO: 509 - DNA, 500 bp, Homo sapiens
gatgagaagtctttgcaaaggtatataagaataaatacaatacactgaaggtatcacttacactttctttaaaggtaagaatttgtgagacttctgggagaattttgacaggtcctattagaggtattttaaaacacacaggggaaagtgatttgatgttaagcagtggcaaatctacacaaaaacaaaaacagtcatcggagactttcactcaatacaaagttctaccagacctatgcaaatagtaatcgcattttctagaaagagttctaaagtaagtcacacacacaaacctcagtagtagcacaaaacatcctttgttgccggacgtgagaaaaacacactcgcttctaaaaaaagccataggaaggaagtggaagaacctcaggggcgagtgggagtgcgaaaggaatgttgcagctctttttttttttttttttgaacatgtaagcttgctgtggctcttaatagtagggctagtagttcaagtaagtgaagta

SEQ ID NO: 510 - DNA, 500 bp, Homo sapiens
gacagttgcagagtccgtgtttgggggggtttgtgacgtcggcctcgcagagcggtgacagttgcagagtccgtgtttgggggggtttgtgacgtcggcctcgcagagcggtgacggtcgcagagtccgtgtttgggggggtttgtgacgtcggcctcgcagagcggtgacagttgcagagtccgtgtttgggggcgccgtgaaagcacccagcgtagtcatgctgctgtgtgcgatgggtgctgggcccgcagacttcggtgcttcaaaggcctcactgctgagcacgagacgccgcttttgatgtcgtcaggctctctggtccccgggagtggactcgggggctccgagtgcagggctcacactgtgtctttgagggctggtcacccacccaggcacacctgtggccctgagtcagcactgcctgacgcccaccctcaggagcccccgcctgcctagggtgggaccatgggggaggctggtcctccattctcaggggc

SEQ ID NO: 511 - DNA, 500 bp, Homo sapiens
agtattccaaagtgcttagtttgccactcgctaagtttacttaaaccctctttaacaggctcattaggagctggtgagcaccgggaaattcattaacaggaaggcggccccctgcatttgactgtaaattggtattgatcaggggctggtggaggctgggcggctggccacaaagagccaggtgtgggaccagcctcccgggggtgccacggcagtggcgctgggcaggtgacggtggctgctgacccccggtgcccatgtaagctgctggctctgcgcagctgccgcttcaggtgggccgcactgcgcggcggttcagggtggtgacgctgcgaggcggggacgggggagagggtgaagaagagcgagagaaggagggagagaaccgggggagcgacgctccctcgcccactgggtgtctgctgtggccaggctgaggcacctagggagttgcccccctagtggacggcctctcaggagatcctgaccaccctctggga

SEQ ID NO: 512 - DNA, 500 bp, Homo sapiens
ttttaatggtttaaaacaacaaatcgatgaaaaatatatttcattcttgtaactcttaggaattctcagattgatcttttggctgcgattgtatctaaatgtcacattgttcacttgtcagtcttgcctccgtcactgtgagcatgtgcgtgtgtgcgtgtgtgtgcatgcgtgtgctgacagcccgtatctgtgtcatgtgtattgccggaatactgaggggcacttggcaggtttgtgagcaacacccgggacacggcattgagtgccagcgctgagcaggggctgcccggtgtctcccgggtgcgcgcctcggggctggaggtccgtccccatcacctgctctgtgtggctctgtctcacaccctccgctttcagcccctgggaacccaggaaacgggagcagcctggcaggcgtgcagccgtgcacggcttagaggagctcccgagcgggacaggcaccttctgtgaagggccagagcgcagtctctccagcttcg

SEQ ID NO: 513 - DNA, 500 bp, Homo sapiens
ctctccagtccccagggtttccccgtatttctctggccctattacccctgacctatccccaattatatgagaacttctggcaccaacagcccctcccacgcaggccctgtccctgcctgctgtcctggctggtgcccccagcccgctgtgaccgtgccggctcttgtcctccccagctggacttctggcgggggcctgcccaccctggctcccccatcgacgtccgagtgcccttccccagcatccaggcggtcaagatctttctggagtcccacggcatcagctatgagaccatgatcgaggacgtgcagtcgctgctggacgaggagcaggagcagatgttcgccttccggtcccgggcgcgctccaccgacacttttaactacgccacctaccacaccctggaggaggtgagggcgcccctagcggccgctccctgcagccaccagctcttcatcatggctggtagaacgcggtagggccaaggccagggccagcct

SEQ ID NO: 514 - DNA, 500 bp, Homo sapiens
tttgaaagtatgtcagagagattgattttccacgcgatgcgcaagtgggagtgtgtttagtgccctaagtatttaccctgctttaacacgcttacccatctttttaatggtttaaaacaacaaatcgatgaaaaatatatttcattcttgtaactcttaggaattctcagattgatcttttggctgcgattgtatctaaatgtcacattgttcacttgtcagtcttgcctccgtcactgtgagcatgtgcgtgtgtgcgtgtgtgtgcatgcgtgtgctgacagcccgtatctgtgtcatgtgtattgccggaatactgaggggcacttggcaggtttgtgagcaacacccgggacacggcattgagtgccagcgctgagcaggggctgcccggtgtctcccgggtgcgcgcctcggggctggaggtccgtccccatcacctgctctgtgtggctctgtctcacaccctccgctttcagcccctgggaacccaggaaacg

SEQ ID NO: 515 - DNA, 500 bp, Homo sapiens
gccctcgcacttgcccgaggtgccggcatgccgagtcagttgtgcccagaaattggcagttgtccccatcgacggagggtcaaggtggtcggacggggagcctggggagataatcccatctccacggtccggttaaacacacagcaccgcagccatggagagcaaactctccgtccgcaggatggatgtgcctgcgccggtcgcagccccaagtccattgcatccttcatcaaccgccggtcttgtacccgtctgacagaaatttaattcaggctggctcctgaaaataattattgtattttaagagtagtaatcattggccgggacatgattgaatgtgtccatgcctattgactttttctatgatttatagctttgtttagtcgatattcccatcgaaattgtataattaattataagtgtagctgtcagggctgcaggatggagtgccctggtgaggatttggagagattaaattttcctcggctgtcccagggccg

SEQ ID NO: 516 - DNA, 500 bp, Homo sapiens
ggggggaagaacggccgctagatttggcaacatgaggatgacaggtgacctaaaaaagcagtttccctgaagtggtggggtcagaggccagactggtgcaggctgaataaatggaaggaattctaataaacatagtggacgaagtacatatatgtatctttctctctccactccagtcattcctaaaacccacgaacatgacccccacaacctgagacatttttttaagaaaggataaattaaccaggacgacacaaatgcaaacagggtatgatatgcaaaccagttttttaaggccataaaggagaaactgatgattgatgactgcttagcagagccaaaagataaaactcaaagcctgcaaagggcacagtggttggggtgaggtgtgttattgagaagcaagctgattcccactaaagggactgtaaaaaccaggtaccacaaaaggcaatattgaaagatggcgctaaaagagaagggctggttaaaagccagta

SEQ ID NO: 517 - DNA, 500 bp, Homo sapiens
accttgagctgcagcagcagccgggctcaggtgcctgtgttcctgcaaggccagctgagtggcttgaaggagcttttgtctgacagtcctggaaccagacattgattgctcttttctttttccttgggagcaaaatcaaacaaaccccctacttcagctgttgatctcattccaaactcatgcctaatctctgtcgggcgtttacaggaaagccttctaacgcctctgttatcagcgcatgacggcagacgaggagccgccatgctggtgtcacttggtgtggtgcgctggctcccgctccctcgttacaaatccggaaacattttcccatgtgtaaagctcaggacacatgagcctgagcttaatttagtagcttatggccaactcatgatggaaggtctcagactgtacggaattaaataatacccgaagatgtcatagtccgaggcaggagctgaagaggcgttggccgcggccagttggctttcaccgcagcccgg

SEQ ID NO: 518 - DNA, 500 bp, Homo sapiens
aaaagcagattctttatctcattagaggggctgccactgcccttggactacaggagctattttccaggaatgtaatcaggcttgacccctgcctcctagctctcgccatgctgtgtctcctagtaaatacctgcctgcaactcttggcattgtttttggccttgagggcccagcctgtatttcaccctgttctcaaggcctggctgcattgatcagcccactggatttactgcctgaaacaaagcttagcgtgatacttgatcgatctctcctcatttcatgtcactcagaatggctcctgctggaaggtacctgagagacgatctggttcaattgtccttaaccagggtaggcatcaacaactgcttgtgaagctttgtaaaaataggcagggccaaactccaggaggctcctgatttggtgaacattctctctatagtgccatggcagatatatcagttaccctctagtattcattcttgcctccttcttcctctgct

SEQ ID NO: 519 - DNA, 500 bp, Homo sapiens
aaatgagcattttgtgggaaacatttttatccttaactaaaacattcaaagcacagcttaattttccttcagactctgggtcctcgctgtggaagatggtcattccttggagctgcaatcaggatgactccagcagggtgcccacttggccccagagaaaatggctctagatcactgcatcttgcagccttgcatctactcgcaatggtcagtcgtaaccatgtgaatgaagcgattcacagaggcacacggggatcaattatagcaaaatggccgaggtgaacatcaccctaatccattaaactgctccagctcagctgacacataatcgatagcgtcgtaatccatctagttaaaagtttgcagaagcaaggagagagggctggagcgagatccacggaagcaggggtttgcttccgtctcttaaccctgagccgccacaggtctacgtcgtggggccaatgttattatatctgcaaactctggccgaacttacacac

SEQ ID NO: 520 - DNA, 500 bp, Homo sapiens
gtctggcatgcgtcactacccctagaattcttgaagaactcttctggcttttattacattagtaacttaggaatgtatttgcccttccctctttcttagaggctggaagcttttagtatttgtgcctttctgatgctttgttctcaccttggaagagaaaacacaagagtttcaaaagcaactttgatgtttccccagacgaaaggcccttttgggaagttcaggtggagttaaggccactgttcaaagcgtactgcctttgtgtgcctgaagcttgaatgacaaccattgaccgatacgactggccactctttctttttttgtgtctccaactggccacattcaaatgtagttatttcatcagacacagcctcaaaaattaccccacaatttctcatttttaagtacagccacttagagtcatttttcttagactgaaagagacgttatgacacaagcagaatacagacactgagcaattaagttggaggataagaaag

SEQ ID NO: 521 - DNA, 500 bp, Homo sapiens
atacaaaaattagctaggcggggtggcacatgtttataattgcagctacttgggaggctgaggcaggacaatagcttgagcccagggggcaggggttgcacagtaagccaagattgcgccactgcgctccaactggacgacagggcaagactctgtctcaaaaaaaaaaaaaaaaaaaaaaaagacagaaagatagaaaataatgaaaggaacgtgtgatagaaagcatgaaggcaagaatgaactaggcgaggaactgatctggattatgtagtagggaaaaattgaagaatgacaggaaagaaaacattggctgatgtattaatttagattgtcttctcctagagaaacagataatgcaatgaatgctggcttaaacccaacagtgtgttgtacgagagctgtttcttgaattttcagaagttttgcatgccaattgttaaaaacagccattattgaaaattagatatgtaaatatgttatttacattatccatgtga

SEQ ID NO: 522 - DNA, 500 bp, Homo sapiens
ggaatcaaaatttatttgcaagctgacttgataaactaaatgaaccaataaaatttgtagaaatgctatcctgaaataattatatacatgaagacaatgttgactaatgaattaagatacattatatactagttaatgctaactagtctcagtacctgtttttagccatctgttactgtccaatagcacctcattcccacattctattttcccccggtattctttagatcctagtatttggaaaacaatcggctaaccttgacatttctttttaccttcatatgccactatctcggtagttcaaaaaaatttagttcttgataaattgccttgaagtttaccttgtgctggagagccttatgataactccaaagactttcttacggtataatacatgttgtttaggattgtgtttcttagtcactgaagataataaatattaaaatggatgttttcatcagaaaattttcatgttttcctttaaggtaacataattgtaa

SEQ ID NO: 523 - DNA, 500 bp, Homo sapiens
atgtaaagaaaatggacagacagaaccaacattgatttgactgggtgaaaaagtccatttgagttgggagcaggggttgtgttcctggatttgggttgttaggacagtataaaaaggcttcacaggggaacattcttttctgataaaggaaagcagctgggttggcttcaaatagcagtgactttacttggaatattcacaggtaagctgcaaatataaaacaccttccacagagtgttattttgtaatcggggcttatctcaagtgcaagaacctccagcctacagctttagtaggtgcctcagacactgtgcccggctttagtaggtgcctcggacactgtgcccggctttagtaggtgcctcggacactgtgcccggctttagtaggtgccgcggacactgcgcccggctttagtaggtgccgcggacactgtgcccggctttagtaggtgccgcggacactgtgcccggctttagtaggtgccgcggacactgtgc

SEQ ID NO: 524 - DNA, 500 bp, Homo sapiens
tgtctttgctagcacagattctttttgctgaactctgtactactccttgtcagtccctaatgttaatttaggttaaaagaaatgtaatgctcgcatcagtaaaagcaaggtcagactttcacctgaacagttttatttttgttttgttccgtttttactccgaggtcagaatgtcatcaggcacaataaagatagcttcttatcttcatgggattgtgcccagaaagaccaagcacagtctaaacattacgcgataagaaaaaacaaaaaatagatcaagtgaccttggacaagtcatcttacctctcgatggttttgttttatgaaagaaggtgtgtgtgtgtgtgtgtcgatgggtgtgtgtgtgtgtgtgtcgatgggtctgtgtgtgtgtgtgtgtgtgtcgatgggtgtgtgtgtgtgtgtgtgtgcgtgcgggggttgagaaggttgctgttaaggttccctagggctacctgcagctttaatatgcgtagtta

SEQ ID NO: 525 - DNA, 500 bp, Homo sapiens
tactccagcctaggtgacagagcaagactccatctcaaaaaaataaataaataaaagaaatggcttgttgcccacctttctgcctccccgcctgccaaatacatccacagcacttgtgggaagatccgtctgagaccatggattccaggctgggctgatgccggcacgcaggaggcctcgcgcaagacggctggtcccagccagacccagaaaaattagattaactcggagaagctcgccaagacgatccgtcaggccgcctgaaggacagcgtattgatttccacgttgcgaaaaaattaaatgatatccctttttgttatttaaaacgctgcttaagcaattccctaatggaacggcccggcccgggtccaggaactccctggcccggccggcagcgtctccggatcgggtggaggacgagggaatgcggacacggccctgtcttcccctccgggtaattgatgacctcaggagaacagctccattttgcctgcatgc

SEQ ID NO: 526 - DNA, 500 bp, Homo sapiens
cagtggcgcaatctcgtctcactgcaaactccacctcccgggttcacgccattctcctgcctcagcctcccgagtagctgggactacaggcacccgccaccacgcccggctaattttttgtatttttttttagtagaggtggggtttcactgtgttatccaggatggtcttgatctcctgacctcgtgatccacctgcctcagcctcccaaagtgctgggattacaggcgtgagccaccatgcccagcccgctaattatttcaatttgaccttgacactgagcctgccaagtaggttcaagcattttgatggcccctttacaggttgggaaagctaatttatctgtccaaggccgaattctgaaactgagtcttaactgccaaaaattcttatcatcaatttcttcttctgggttgggcacagtggctcatgcctgtaaagccagcaatttgagaggcatcatgatgcaagaggaagaggattgagtgaagctaggagtt

SEQ ID NO: 527 - DNA, 500 bp, Homo sapiens
ggccaggccccggccctccttccctctcgctcgttcccggttcccggccggctctccgcggggccagctgggcggacccggacctcaccttccgcagcttgtactcctcctccacctggcccagctcattcaggtggttgagccaggcggagacgccgagcctcttgtacatgctctcctcggggtgcgtctcggaggacggcagcttggggcggcggatggagaactgcatgcatgtcttatcgggggcgacctgctggacgggaggaaaactgggcaaaggtcaggatctcagccgcgcggcttcagaggccagcagtgcttttcccaggaataaaagcctctctctcttctgaaaggagggcaagggccgtcccctgcatacaaacccctaaatggcgagtgtaattaggcgcaattaaaatgaaaataccttcatcttaaaatcggtttccctctgcggctctctcctccccggcccactgtgccgccgcccccca

SEQ ID NO: 528 - DNA, 500 bp, Homo sapiens
agggtttcaaagccaaaaatatattttctgatatgtttaaggaaatgagatcaaatttttctttttagaaaaatgaaactaattatcttacattttaaaagacattaacaatggcacttctaggaaaacatgctgaacacattaacacagggtgggaaaaagataaggaaagcaaagtggaatgtgatcgcccagacaaattgtgtccatgagttcaatgggacaagcagggtctttacacagaattcccgggtgaacgggacggagatgaaacagaagttacacttgccaacagccccatctctcatctcaggagagatgaggccagcgaaacaactactagcaactgcttgggaaacatctgaaatatgagcatgtgaaaaacaatatgtttaacagaaaatgagcaagtctattcactgcatatgcagcagctaattatgagaaaaattaggagacagttctgttcattcacatgactccttctcaaccacaatgga

SEQ ID NO: 529 - DNA, 500 bp, Homo sapiens
tttgataattaagagtacgtacaacgtgtatgtaaagtaaataataacatgaacacccgtgatttggagtttagacctaactggtcaaactgcattttttctcctgtcactgctccaattcttgcaatctgtctaattcccacactgttcccagatctagccaatcatggaaaattatcagtagcattgaaggtgcatgtgttctattgcctttattttccaactccctgcccaaggtaattgtatgaccgtgttgtgtgttttaaatagttctacaacatatgtatgatatacatatatgtatagtgtgtgtgtgtgtgtatatcttataaaaatgacatcatgttgtgtgtagtcttctgcaatttgctctttttacccaacactgtttgtgggatttatgcatgctgttatatcttgctacagtctattgacattattgtacatgtctcctgggccacaggtaaaagagattctctggaatatatatctaggagtga

SEQ ID NO: 530 - DNA, 500 bp, Homo sapiens
acacaacaaagacttctatttttttttctatcttttgggcgacacgataaaaaataaccctgtatttatgcaaattgcaaagtagcgtgtgataatgaaaacaaaacagtgctggcccgcagccaagacatggcgctgacgggagctccccgaccatttggctcttgattcttcggggaaagcagctgtagagaaatgagaatacaggaccccctcctcacactcgcacaccctggttcgcacgcattccggtacccgtcacctcggagccagcgagacctgggatccaaatgcggttctgcctcctccggccgtggagcactgcagtgtcgtcctccacgagcctccctgcccctgctcctgattccctttcaggaatttacaaacattttccccagatcaatatccgtattgattattcattgtgagtgagtcgtgtgtctttggtgatccagcttgcagaggtagcaggcaaaggctgctgcgggggaaaaaaataa

SEQ ID NO: 531 - DNA, 500 bp, Homo sapiens
gcgagaaggaaccctttgttctcacccaaggcttggtgggctgctggggagaagaactgaaatggagagtcagtaaacagttgtaaaagactgtgtgccactgagtgttcttgataaatgttaatgagacaggagcaggcattgagattgggcagtattgattatgagcagaaataaaatgagctgaacagttcttcacaatcaaagccatgactgtgttgtgttttgagtatctcttgccggagtgtgcgtcctaataaatctcgggtgtgaaatacgctgttttctcctttctttcctctcccgcttccacgcattcattcttctgctcatttgttcttgcattcactcatttgttcattcattcaccaaatgtttgagtgcccactgcgtacccacacagagctaggcaccagagttaaactggggcataattagacacagttgttttcctctcagagtttatgtacggcagtgctgggagagaggctttaaaaggt

SEQ ID NO: 532 - DNA, 500 bp, Homo sapiens
tgtggccaaggggacagggtgagccagggccagctggggccagccggaggccagggtccctggactgtctagggctgatagaagaggccaagtcctcagcccagccccgaccccagtcctgacccacgtgggatctcccctaggcccgcctgcctcccgtttcccttctgtcaaacagggtggggggcacaggagcagagcccccacctctcctgctgccacatgctgggcccactccccgcgaccgcccggcacactcacatgctcgtgtacacgcgctggccgttctgctggttctgcagcctggtcttggccaggtcgatgggaaacacgcaggtgacaccgatcagcccggcgatgccgccattgatgagcttggctggcaggctgtgtggacaggggtgtcaggaccggcttccttgaccatgggtcagggtgggggtgaggcacgcagccaggactggagtctgacctgatctgcttatcagccatttaactcg

SEQ ID NO: 533 - DNA, 500 bp, Homo sapiens
atgagaagccttttgaaaagaacagcagttggactgagtgtggtgcttttcacacgagcaagtagttgagtgagatttctgtgaggatgtccaatttgaacactattttgaaatcagcccaacttagaaatgaagagccctgcacatactcaatccacgatcccgttcctcttggtccccttctctctttttcctgcagcggccgctgagacgcataatgatgatgtagatgtggcttaaaatgatcatcggtgggggcaggactggcctgtcatgaaatgtcataatcagctgatatcgctggaacttccacacctggttggatattgattttacttcaaagaaggtattgctttaaaaagaagacatttttacagttagttatattactttttatagtgatttcccagagcagtcaaagttactcacatttaagtgaaaatactcaatgagatggccttttagtgccctttagtactgattccttgattatccaatct

SEQ ID NO: 534 - DNA, 500 bp, Homo sapiens
ggatctgtttgtttgaccgttgtatgcaaaaatgattttaaaattggcctccctaatctgttggagacattagttaaaaaaaaaatgagagtaaagaggaaaatattttgctattgggtatgcactggatccatttttaaactgagagaaggtgaaaggggtgactggttgatttcggataatacttttagagccacggggaactgtgaaagacaagaaaatgtaaaaaaagcacattgattgcaggaccggtggtccaaaagcagcacgtgaaagaggtttcaaggctgtttctacaaacaagaatgccaaaggtggcataggacaagaagcttgctggatgtcacgaagctagtggagatgggatccaaagctagttttggctgatgaaaatacaggctcatgccctgtatgtgaggacagtgggacagtaatttaaacagaagtatctagaggagtttccttattgccttgaatgtatttctttttaacattgctat

SEQ ID NO: 535 - DNA, 500 bp, Homo sapiens
tcaagctgcataaacaagaaaacttgttttgctttatttgtggctctacatgaacctaagattatgggaaaacattctatcaatagtctgcttctggtgaacttaacagttttgagaagaaaagatattaccctgctctgccaaattccccgagtgaggatcacgtggggttgcatgcgagtgtattcccacagggggcttggctggattgactagcggcgggtctgggggcgcggccggattgactagcggcgggtctgggggtgtggccggattgactagcagtgagtcttgatttcagcattttgctaaagaccttcttttggagatgttgctttacaaatagataatcactcacttggcactgagagaataagcccgaatttctgtaggaacccagcacctgccacggctccgacgggcgacctgactgctgcaggccatgctctgctgtgagatgcggtgtgatatgggttcaaagttttgcatcgtccagttca

SEQ ID NO: 536 - DNA, 500 bp, Homo sapiens
aaatcagtatcatggaaaagatatgaccataatttagtctcctcaagtgaaaaacaggagtaatgtttcgttgcactttgaaagatctgcttcaaggcataactcgtgtagttgtctggtttcagggatagctgtttgaattgtcattctaaagtaggtcatcaggttcacttattatccgaccttaatctgggataaaggttttggtatttgcccacttctagatagaatgaatgaaaacaacacaagcgttttatgagcactctttatcagaaaggtatttcctggaccagaaatgggcaatagttacaatagttgatcctctgttctggaagctttgaaatttatcagagaatgaagtcattcagtacatctgataaagttttgttgttgttgttgttgttgttgttttaattgggcaaccctcagaactgaagaggttcagagaactttccaggtttatactatacctcaagaccacatagattagctactgctta

SEQ ID NO: 537 - DNA, 500 bp, Homo sapiens
cttatataaaacaacagagataactgcatattatcaaaaggtcatttagagattttaaaaataaaatcattagggaccccttaagaaaagtagagcaatgaactgtaattttaaaaatgtatataatagcacaaaaatcaaagtcttaatggacactcatttgagatagttcattttgtttttgttttgttttaaacatagatttctagagcattaaaaacaatcctcataggtttgttaaacctttagcggaagattacagcccatgtttttgtctttggtgaatagctgtttgtctcactttatttacttggtattggatatttgtcaatgtcatttcatatctacagaaaattcttacgctctgtggaggtagtgaatgtgtgtgtgcgtgtctgccggaggtcacatgacggtttcattctatttggtggagcagcttgactttttttccccttgcttttggtgatggttgtgagtgcagaagttgattgacagat

SEQ ID NO: 538 - DNA, 500 bp, Homo sapiens
atttatgtagcagcatgtcatgtgacaccccagttgccatggcaaatatttgtgtttcatgaaaaatgtgggtaaagaaaatcaatgtaaatggccaaatcccaagacagacaggccttcaggcgagtgtttggcctgcaccattattgtttcaaattcagctgtttaacaggctgtgagaaggccatgggctaatatgcataataggaacaggcggaggcacctgttttgattctcaccctgttggagcgctcaggtcccacagttttatagataacagatctacaggtaatacaaatattatgactaggttttagccagtaaatggtttaccacgaaaaaaatagttttaaataatgacatattttctgaatgctaatgagccctggctttaattttctctgttgacttcacaaagctctccccaactgctggaaacagtaatatttaatgactttttcctgtggtcccagattggtacagcatttctaaattgactc

SEQ ID NO: 539 - DNA, 500 bp, Homo sapiens
ggttcgttataatacgtgttcctgagtttcctctttacttaatgggttagattagcctttccaaggcagggccagggaacctgtgttttcagcatgctccccaggtggttctcgggtagtctgtggactggtaaaacctgctccaatgctctttcctcaatgaataagggatgcctattttaagtggggcagacacagcttctgacttcaaattaatcaaatgacagctagtaattgatttgcatggcccggtttatggggagccctaatcttagttttttcgtttctagtccacagtgtctacgtaatgcctagcacatcataggcgcctaggagacacctgcgcatgaatgaacagtgtcttcactgctttggtcctgccctggttaggacccttgccaccttcacctccccccaagtgaggtgggagctggagccatgagatgaaagacgggaaagccatgaaaaactcatgataaagaatgttgcttctttggtta

SEQ ID NO: 540 - DNA, 500 bp, Homo sapiens
tgctcgagaggcctgggtcatgacgccttcccttactcatgcattctcacggcacttgctgatttatttgaagactcccctattcagaactcctcagaatattatttcagggaatactaagtgggaggcattaggaaataagtccccggaatttgggggtccatgggagaagaaactagaagccagcaggactctggagcaagagtgggctatgggacaatggtcctcagtaggaacgggcctgcatctcgttctcccagagcaaggatctgaaatccaaaagatgatcaacaaatctgcatttcggcaggaggaacattcccagtgagcttatcaggaaagctagcaccaggcagaaagggtcatttctacacagagaaattcacattgtttgtgtcaggcactttgccagaaagcattttgacaaattccctcgttgaatgtgagggatgcaatgaagaatttaaagtttcgcaggaattagtgacataaggcaagtt

SEQ ID NO: 541 - DNA, 500 bp, Homo sapiens
tatccggccccaccatgttctttaattggttatttgtgtaatccctgctctccctgctcggtcaatatctccggaggccgctccccagagcctcaggctgacactaatcctggaattgacttacgtttgtcctactccttattaccttttctcaagctcactcctctggtattgaatggtttttctctccttttgctcttgcaacgttctctacagtcctgttaatttccaggccagctcttcccccaccggccccgcaagccttcagggtgcctcccgctccgtggcccaccccgctgcctgcctccttctactgatctgtcagctccgatctgactcaaggaccaaggcttagtcgtccttctacctgctcgggttcttgcacaagaataaacaaatcgataaaaaccctggattgagagataaagttaaaaaagacctcagagtggcctggtgctgcggcttgctcttcacagccggcctctcactggaggagggat

SEQ ID NO: 542 - DNA, 500 bp, Homo sapiens
gtgggtgctggaggcgtggactgccctgttccctccgctccccgcctgctgagcacctgccccaccccgctcagcgtgctgcaggccgacccctccaggattccggcgcccaggcacgtctggtctcaccacgcgctccccatcacggacctgcactgcggctttgggggccccctggcccgggtggccacctcctcactggaccagacggtgaaggtacgccgcccccaccccaccacggtccatgagcggagcccagcagccgcaggtcctcagccaggaatgcaggaatcgcctcctcccgctccctgctgtcaggactccagacggcttttaatcccctggtgctctgagcccaaggacgtccagggaggtctgccagcctggaaattcctactcattcaccgtttctggcccggctccctggccaagcctggggaatcggaggtcatcactatgcttgagtcgtgaccggtggtcctgggagggagaaccagggg

SEQ ID NO: 543 - DNA, 500 bp, Homo sapiens
gctggacgggtcaaggagcacagtgtggaaagagggacaatttgctacaagttggagataagagacatggcatactgtgaaaccagtgctgacggaagaaggtgactttcttggaaggtcaagacacttgcttgacagcgatgtccaggagggctagggagagttctgctggaagtgaaggcagcacctgagggtggctgagggaactggtcagggctgggaacgcctccagccctttgaggaatgattcgctgattaagagatgtttggccttgaaaattgcaagaatgaaatctcttggtgggaatgtgtagccaaaagccagcaccctgagtggctccaaggtttggggaccctctcaaggcacaaatcccagttccttttcaattttgaaaatcgttgtgggcgattctggaattgagaagtgtgctgagagccatggatttaacatgacaagaatttccgccccttcgtcactgagcacaccgcaaatgctccag

SEQ ID NO: 544 - DNA, 500 bp, Homo sapiens
agctgcataaacaagaaaacttgttttgctttatttgtggctctacatgaacctaagattatgggaaaacattctatcaatagtctgcttctggtgaacttaacagttttgagaagaaaagatattaccctgctctgccaaattccccgagtgaggatcacgtggggttgcatgcgagtgtattcccacagggggcttggctggattgactagcggcgggtctgggggcgcggccggattgactagcggcgggtctgggggtgtggccggattgactagcagtgagtcttgatttcagcattttgctaaagaccttcttttggagatgttgctttacaaatagataatcactcacttggcactgagagaataagcccgaatttctgtaggaacccagcacctgccacggctccgacgggcgacctgactgctgcaggccatgctctgctgtgagatgcggtgtgatatgggttcaaagttttgcatcgtccagttcaatc

SEQ ID NO: 545 - DNA, 500 bp, Homo sapiens
gctttgtttttctcccagcttgtactctggaccctgttagccaacagtattggcactgcctcacagcgatggtcagtcccaaattaaacagcctcgttatgacaccctacagccaggctgcagctctggacttgtgcttctgcacgtttccttccagttgctttcgtccagcgtctcggtcccattgagtaagggagtgtgtgcagagtatgtcccgaggttttctcctcagtcaagcagactacatttcgccaggtgtaaaatcggtagtttcgaattcaccccttttcatggccttgaggagatgcttgtctccttgtcccaagggaatattggtgcataaatcatttcccgtcctaggcatgttcattccagaaacctttcagaacagagtgtggagtcttcataaaaggaatttgtcatgagcgcaggggtttttttttattttttattttttaaaggggaaggcaatagaggtattcattatctgctacagagtg

SEQ ID NO: 546 - DNA, 500 bp, Homo sapiens
aagcatcttagaatagtagttgtagttttaaaagtttttacagtgaactttgaaactggaaattctcacgtagttaattatgaataatctctcttgaacactgcctgtattgaactaagtagttgatgaaaccctttaatgaatactgttagcacctgtcatttatttatactttaaatatattgctttactcccccccacctttttttttttgtgcagcccgacaagagacaacctaaataaaaataccgtattaccttttctagttcagggaaggtgtatgattaaaagtcagatttgggccagtcgtggtggctcagactgcaatcccaacactttgggaggctgaggcgggagaattgtttgagtccaggagctggagaccagcctgggcaacaaagccagaaccttccccccgcccctgccccaataaaaatttaaaaatgagctgagcgtggtggtgatgtgcacctgtgttcccacctgcttgggaagctgag

SEQ ID NO: 547 - DNA, 500 bp, Homo sapiens
cgttacaggagtctctgatggtttcatgtctgccctcccaggcctttctctgagacaaattatgtatgtgtaaatttcgtccacacaattgcatagacatgatgtaattgcagactgagttctttgagcaccttctctctggtatgcttaggaatcttgttaaacacataacttgaagctgtagtagcctgtgattgtaaggaggggactgtctgtgttctaagtctggtttctggctgaccttggactcggcagtggtgtctgcaggcgggtggcccgttgtgtacgattgtgaacgccgaagagatggtgcagctcaattgatgccgcttcccagaaagaccgagagaaaagcccctgggagcttttgaatgcttttgccctcgcctgggcaatttaatgtgttaatgtgccccacttagatggagcggctgttgacattttgccatatttactttattgtgcctctattttttaaaaaattgaaccatttgcagtat

SEQ ID NO: 548 - DNA, 500 bp, Homo sapiens
tcttgttctttggccttatgatttcggagattgcacggcactaggagcttctagttgctttagtttacaggcctagagtgtggtggaagttgtattctggacctgggatttggtggagtgctatgaccccaggaaaatccctgcttttctcttagtaacgtggtttctggggatcctacctccgtcggtgtatagtttgtgccctggtttttgttagcttgcttacccttctctgccgtgatttaggagcgccatgtggaggaatggctcttctcctgcagcttctcagctgtgtgacttctttggaaagatggaaataatgttactattgagaacacctgaacactagagagcaagagtgctgggttcatgtcccagccctcctgctaacttgcagtgtgtggcttagccagtaatcacttctctgatctgtggtttcttcccatggggattttacagtatctctaagggattgttgggagaattaactcagaatacaa

SEQ ID NO: 549 - DNA, 500 bp, Homo sapiens
ttcttactgatttcatctagttaggcctccgtgtgattacactgagcattgcacgctctcatttaagatctcacttgcctccatcttcatccttcatttccctaacttctcaaatcctcactgatctttgattttctggctcttatcttggaaggttatttgttttgtttggtaattgtttgtatctcccctccccacacatgaagggatcagtgtacctactctatttcttttatcaaataaacacagcgctgagcaaagaaagcaacaaatatttaaccagcttttaacttatccactgacatctgtgagatttctgaggttctatttcaatgctccttgatattgaatagttgcttcaacttaaaaagtactatttttcaccttagaaatatttcttttggccaggcgcagtggcttacgcctgtaatcccagcactttgggaggctgaggcgggcagatcacctgaggtcaggagttcgagactggccaatatgga

SEQ ID NO: 550 - DNA, 500 bp, Homo sapiens
tgcagaccggctggtggtggtgtctggttcctccttttagccaacaccgctgatggcagtagggagacagtgcttttagaaaatctaagagctgtttgaaagtatttggttaagaagtaactactgttacctagttacagctgccaaatccagggtcactggattgatctcaattcctgacttttccattgacttcagagtgagacattctttgctttggcatctgtaattttcgatccacaagcatagcgtgaaaatacttatgctttcttagtagcatttcagacacgaataagttaatacttgtccttatcacttgcgtagaaaggaaatcagtactatacaaagtctgtactccctgaatgtcttcctctgtgcctggatttttaatatcttttttgtatgtgttttaaacattcttgtatataattaagcataactgtgagtgtaggtaaactattcatattccaggattaatttatgtaaccgtattactttca

SEQ ID NO: 551 - DNA, 500 bp, Homo sapiens
ccgcctcacagcttttgcaactcctgttctccctgcctggaacatgcttcccagtgatattgtccattcccggtgtcatttgtttgctgtcagcactcccactagaatgtaagcgtcacaagagctttgttcactactgtatccccgcagtgcagggctcacatagacagttaataaatgtttgctgggttaataaatgaatgaatgaactatgttatctatttgatttcccaggtggctaggctcctgcgcatgtccttgaatttgctctccaggccctcctgtttggctgccgctctggctcctaagcaaggagtacccggaggtactctttttgacagtaatgcgttaaaggcaaagaagaaagtatggctttcacagttttactgggaggcctagaatgatttgaaacggacttttgtttcattaatgggaaaagcaaagcaaaacaaaaagcctatcatctaacactctttccctggatccaggaaattcttgtc

SEQ ID NO: 552 - DNA, 500 bp, Homo sapiens
tgcctcggcctcccaaagtgctgggattacaggcgtgaggcaccgcgccgggcctggcttcccgaaactcttatcttctctcttctggcgtcctaagggcactctgtacacagccctatcagaaacgaggtcacactgcactgttgtttacctgtcagtctctctccctagatgtatagcttttttagtaatttgttgacattatcacttcaatgatattactttgtgatactgacattatcacttcaacgaacacaaatcacccacaatcgaagattccagtgaagaaccacagatatggagctgcattggagtaaagctaggtatcttgtacaaaaccagtggttcctcacctataacgtaacacatttggagaaatttcaaactcattaactgactatggcctcaaactaaatatgggaacataactgaggaatgaatgacaattgaattgcataccctgttatacatggctaaaatgagtttaagctgaataatta

SEQ ID NO: 553 - DNA, 500 bp, Homo sapiens
tggtgaaatcatttaaggagaataaaagcgatatgttaattaaataaattcaaatgatttttacaccaaagtaaattgaaatgccattccatactctactaaacattcataggcaatgttattgcatacatacttattcaaaagctatttatttctaaggtacttaccccaaactgacttctgattattcactggaatgttacaactaaaatacgcttgctggaaaactcttgtacataaacacctgagcgatcaaggccaactccatttatcttgaccattgcttgattaattcctctagaacaaaagcaggtgttcactacatttgtattaagaactaacacaatcgggttaatgatcaactgatgaaatgtgcaagaattgagaaaaaaacaattatagaattttttaaaagtattaaatttatattattattttatccattattttgcttcttttaaaagttgcacagaatttgaaaggatgcgctactggttgta

SEQ ID NO: 554 - DNA, 500 bp, Homo sapiens
gcctggaacagagatagatagaactcagcagatggtaatgaaaacagaatattctatggagttaaaaatcaatagattttagccagccatatgctaatgaactactctgatttctttaccaatctcttgggggtttgagaaaattatagcagcaagcctcaacctgaaggcaggtcagcacttccctggtgggctcttcctaacgcccctttacagccacagacagtggtgggtgaagtcgaaatgctccggtatgccgtattgatttaaagacatatttgttctcctctggtcagaaagagtactgaacccgaattgcaggactctcataattggattcagcatgttttgtattaactaattaggagttttccttttttgtgcttgcttctttttgtctgctcagctcttttaattctctttcttccgtgaagcttgaacgcaagactcattatttcctttttaaatatttgactatgcactttcagcccaatgggggt

SEQ ID NO: 555 - DNA, 500 bp, Homo sapiens
ttgtggcttaactactggaagccctgcctgaccaatctgcagtgccttccgggcaaccacctctgcacttgctttaccctctacagaggggagcctggttaatcaggaaagaaactccctcaaaaggtaaacagtgagtagagtgtacatatggtggaaaacaaatgactcttggtaccctattgtgggaattatctcacttcaatagataaaggagtagggcaagcccaggtggcactggtgagtaaccgcctccattacatggtccgttcctgacgtgtacaccagcctctcagagaaaactccatccctacactcggtagtctcagaattgcgctgtccacttgtcgtgtggctctgtgtcgacactgtgcgccaccatggccgtgactgcctgtcagggcttggggttcgtggtttcactgattgggattgcgggcatcattgctgccacctgcatggaccagtggagcacccaagacttgtacaacaaccccgta

SEQ ID NO: 556 - DNA, 500 bp, Homo sapiens
gtgcagcaagtcattggttagaggaccagcggtggaaatgaaatttctatcagactcccagtctgacccccagcatgaaaaacttagcagggcaataaagactacatgccaagacagctccattttctaggaactgttaggaggtatgtggaacccttactttataactgcaactgaggttgtaaaatactaagtgataattaagacttaatatttaactgggttatctatgatcacaaaatcagtacacggttcactaatgcaatatttaaaaatgtaaagatcagggccgggcgtggtggctcacacctgtaattccagcactttgggaggccgaggtgggcggatcacgaggtcaggagatcgagaccgtcctagctaacatggtgaaaccccatctctactaaaaatacaaaaaattagccaggcatcgtggcatgcgcctgtagtcccggctactcaggaggctgaggcaggagaatcacttgaacccaggaggc

SEQ ID NO: 557 - DNA, 500 bp, Homo sapiens
tcactgcaacctccgcctcccaggttcaaatggttctcttgcctcagcctccccagtagctgggattataggcaagcaccaccacgcccgcctaatttttgtgtttttagtagagatggggtttcaccatgttggccaggctggctgtgatccacctgtctcagcctcccaaagttctgggattacaggcatgagccaccatgcccagccaagggttgtctttctagagacctctacagtacaagtctacgtcactttgaagtaaggcccaggccaaaactcttggcaagattgggctggaagataggtgtggccagataagaaagaaccattttagcacggtgcctgagcctgtgaataatcaataaatatttgtaaagtgaatgattcatcaaataaattaaggtaagaagtgagaaaggaatcaagacagaaaatccactttgggtggctgaggcaagacaattgctagagaccagactgggcaacatagtgaggct

SEQ ID NO: 558 - DNA, 500 bp, Homo sapiens
ttcaccatgttgcccaagcaggtctcaaactcctgagcttgggagctcagcccactttggcctcccaaagcgctgggattacaggcgtgagccactgtgcacggccagcatatgtgttaactcccttaattcttatagcaacttcacaagttaggaaatgtagatcagagaggctaaataacttacccaaggttaaacaactaataacagacatttggagggagaaaaggtaataaagataaaagaaatcgaaatggaaaagagataaacaaatactaggtttggagctgtgtgagttcctaaatgtctattttgctcaaggtcagaggcaacttttttgtcttccatgaaaaaaaaaaaatacatagcttcatttagtttcctcctttttgggggaaaatggaggacactattagaatgtcgttctgcttatgagatgctagcaatagacagttgtctttgcttttcattttcttacttgacaataacatggtgacaaa

SEQ ID NO: 559 - DNA, 500 bp, Homo sapiens
gcctatgtggaaagattgtaccatattccttggtaatagtttccaatgtctttttttctctaatagggcctttaaaacactctacttaaaaaaaaaaaaaaaaaaaggctttaacaataccaatactgagtaatccatagcattagcctgtttccacgcacaagtctgtccttccccagttacctgcttttctgtatggtagcccagaggccagaagaggggctctgttcctttctcttgtttcctttgcgctatccaggtgacgctggcacagccttcaaagagcagcagaagtaatttgctcccagcgttctttgccacacagagtggcaggattagatgttgacttacctctgccacttccttggtggttttgagtagtacagtccctttctgcacgttagtgtgcaggcatgttgcctgcaggagcctttttaaaggaggagctttggacttgtcctgcagtatagaacttggctggcatgctgacccagggcacc

SEQ ID NO: 560 - DNA, 500 bp, Homo sapiens
ccgctctggctcctaagcaaggagtacccggaggtactctttttgacagtaatgcgttaaaggcaaagaagaaagtatggctttcacagttttactgggaggcctagaatgatttgaaacggacttttgtttcattaatgggaaaagcaaagcaaaacaaaaagcctatcatctaacactctttccctggatccaggaaattcttgtctgctctacctcacacccaagctcaggtgaccggtctgggtgcggcgtggagatggcgagagctaagtgctatggccgcgaaagggtgaagggcaggggaggaaaaggccgaggggaggcgaacgctcaggttcacacatatgcaagtgggctctacagcggacttcgaagcatacactcaactccccaccatgcgccggcccgctgctctacccctgaaaagctctcccctggcccgcgatccttgctggcctaccccttggtcgttcccatccccctctccgcccccgccc

SEQ ID NO: 561 - DNA, 500 bp, Homo sapiens
tgaaaagaataaaatagctcattaacattttgtttatatccattacatattgaaatgatgttttgaatatactaggccaaataaaatatatcattaaaattaacttcatcttgttttttttttaacatagctactaaaaaaattaaattacgtatttggctcgcattttatttccatcagaaagaactggcaccaccactagagctatttcatctggtgcaatacttggctatgtggaggtctggaatccggctgcctgggtttgcatcgtgactcaccaatcactgtcttcctcacctgtgtgtacctctgtttcttcaaccactactattattatcaccagctggggcttctgctttaactggctgtttctgaaggtcaaatacctctctctaatctgccttcctctttaaaccgtcagagaggtgcatgcttctactgaggaatgcatccaacctgtggttaccaatctttccatacatgagatgctccttccaatg

SEQ ID NO: 562 - DNA, 500 bp, Homo sapiens
accagcctcccatgtctgcctcaggcctcttgacccgcctggcactgaccagactgtgtgcccgggtgccgtgcccatgggctccgcctcccccaggcaggccccctcttgctccgcggccacccctgctcttgacctcacacctctgcggtgtgtctggacacaccagcaccacggcgggcggggagcggaattctccaggtggggtgggcaggccggcgggtgttgaggtctctgtgcatgcttgtgcgtaccctggactttgccgtgaggggtggccagtgctctgggtgcctttgccagacaactggtctgccgggccgagcattcatgctggtcgccatcacgtgactcccatgcgccctggccctggggttgggtctgcaggactgagaaccagcggaaggggggcgaggcctcgggaatgcgccggcaactggcgatgagctcaggcctgactaatgagcccaggtgactcatacacccggggcctggatgag

SEQ ID NO: 563 - DNA, 500 bp, Homo sapiens
ctttttctcacattacagatcgatttctctagggcttctggttttttttcttttggaataacctacataattactaatagatttcggtaatttttttatttcacaagtgtttttcacatttcgactccctgtgcaaatacagttgtaaacacaggtgaaattttaaatcacttctgaggaagaagataacatcatggaattccacaccttttttgaggataagatgtgcatatgcttcaactatgaaaacggtagacaatgttgtccagaaatggcatgtatcagctgctcttgagaaataaaaataaaattctaagcaccccctaactgactgaatggatgccctcttgaccatgagaaccctagaataactttggaagctgaattcaccactatagaggaacgggaaatcagacacacctcattatatcccctaccacactacaatcattaggttttcttccctaagggctaaatagaaatcaaccttttcagaagac

SEQ ID NO: 564 - DNA, 500 bp, Homo sapiens
tctgactacagctatctggagcttcagaagaactttatcagctcggcatagggggaaagaaaggagcccgttcccatttatctcagctcggctcccttcaaagccaacaaataaattacagtgtacatttgatacaaattgatttcttaactcaaataacaatgttgtcctcccggtcgggctatgtgtcactcactcgcgagcctgagtgaaaggctcaatctgtctgtgtgacagaaataggcctggcgcgctcgggaggaatgctaatcgcccgggcctggcccggctttgtgggccggctgcgataagggggatcgggcccagccgctccccaccagggccccatcctgtccgtgccagcgcgagcccttggccttgggcttgtcggcctatttcactaggaaaatcagatccggccaccgtggctaggatgctcgtggccgggatgagccggagctgcagtgaaaggaagcccgttgagtgtcttcagctgatgt

SEQ ID NO: 565 - DNA, 500 bp, Homo sapiens
tcatttttcattgatatcaaagggaaattgcaaagagaatgacctatttgtctggcggacacactttctgtaccttaatgatacatacaattctatccatttattctcattttaatacatgaaagtggcacgaagtcggagatcaaaagccagccagacattaatctcatggctgctcaaacagaactgcgtctattcccagagaaatttctaaacgaagaagcaaatatgaccacgggttcccggcctcgtgtgggatgagactcgtgctgtctaggagagaaaatctgtaggtttcactggttttagcacatccctaaaatgtatgagcagcacacatacctctggagccctggccaaagttagtggctgagcagaagacacgtgcttcgcctccataaagtcgtctgcgtggcacgtcagaagcctgcagtcctttcaacttccagttcccagggcatcatcaatcacgtcgcagcgattcctatttcacgtcatgg

SEQ ID NO: 566 - DNA, 500 bp, Homo sapiens
tgggtttctaaccaggatcacagacacacattagtggagtcacactccaagtccctgtttataaattggcttttaaatggtaggagattcaggtataataaactaagctccaagcaagaacccactaaaacaaggcatgctgtatatgataaagtcagaataaagcagaatttgatgaagccaatttctggaagaaactctacaatcaaaactcatttagccactcacaacctactatagtttgaatagcgtacactcttttagccaataggattcatgttttgctgcccttccgctgggagactgattaaatgtctgacaagagtaaatgccattgaagtggccagagacctctcgcagacacaacgatgggcactatttgttgcaaaatccagctctaaggacaaaatccaaacccccattgaggggccccacatccagcatcttccaagtcaacaaggagcagttatattttgcaagaactcgcagtcaagcctcaa

SEQ ID NO: 567 - DNA, 500 bp, Homo sapiens
attaaaatagagaacagaaagattaagtaaaaataaagaatagaacataccagcacacctatgacaagggtaagtatcgtttcataaagcttgtgtttcagttttgcatgtgcatgtaatcgtgtttgtgtgtgtactgggtaccaatgtaaaatgtattcgtgctatgaatctgggtgaaaaacgtttaagtcattagtccaggctattcctccatccatttgttaggtgacatacagcatagtacagcggagccagaatacctactgcacgtcagttcttcaatctttttttttaattgatttatttatttttgagacagagtttcgatctttttacccaggctagagtgcagtggcgcgatctcggctcactggaaactccgcctcccaggttcaagattctcctgtcttagcctcctgagtacctgggattacaggcgcccaccaccaggccgggctaaattcttcaatctttaaagtgaggataataatagtagc

SEQ ID NO: 568 - DNA, 500 bp, Homo sapiens
agccactgttgatcattaaacaaatatcgaacaccaggaaggttattaacagagagagatgtagagcagaggtttagagaagtcttaaacttgaccctttcattgcaagtacctttgtaaaaaaactaactgctgagaatagctaagccatctttgcaattaagaggatgcatgctgattgccaaggctttgttaatctttaatttaattaaagaatttatcccccaaataggaaagaaagcagcggagcggctaaagcgtcatttgatttttctgtcgatgacttgagttgcctttgaagggggtgaatacattgcaggacaggaggataatagaaatttttttcctggggataaggggaaaaaattcttgaataaatggtctaagtaaaccttgagtttttgaagataacctatttactatgtttttaaactaaattaaattaatttatttatttttgagacagagtctcactctgtcacccaagctggagtcaccca

SEQ ID NO: 569 - DNA, 500 bp, Homo sapiens
ttaaaccacttggccttgctccttctaccagaaaaggccggttctgtggacaaaggggctgctcaggggaagaggaggaggagaagatggcggggggtggggggcagggggggcggggggagcaggcagactttgggagcaactcccctccaggcacaccctcctgggaactttgaactgagcagcttcccaaaacgtttccaagcagggcagggctggaggcttaagaaaatcaatgacctggcagggcgcattgattcacacctgtcaccccagcactttgggaggccaagacaggcggattacttgagatcaggagttcgagaccagcctggccaaggtggtgaaaccatgtctctactaaaaatacaaaaattagccggatgtagcagcatgcgcctgtagtcccagctactcagaggctgaggcatgagaactgcttgaacccggatggcggaggttgcagtgagccgagatggcgctactctactccagcctgg

SEQ ID NO: 570 - DNA, 500 bp, Homo sapiens
tgtgagtaatatatgattttttaaaaataataattgtccctaaaggtgaaatggatcaaagcccttaaaagtgaatctgtggtgtagtaactgttaacataattgtcttattttattctcatccccttaaagaataaaactgatgaacaagtgaggatgctggtgtaactccctaacttagtttatagtctgtaagcagaagagtgagtctaaagtacatatcaccagacagtgtttctcctagcatttcgctgttgcattaatcaacaagttaaaatataaacaacggctaaccttgggtttcaaatttaacattccttatctcttagaccaggtttatccactgtgctggggactcccaagccagcactggctcatactgattcattttgatctctgctaataccagagtcctgcgtggcagagccattggcaccagaaattacaagtacgtaaagtaagtaaccagatataatctctgatttctttggatgaggaaa

SEQ ID NO: 571 - DNA, 500 bp, Homo sapiens
tttactctaggatcacctctcaatgggtcacttggcaagggcatctttgcttcttcgtcagctccttttgacacgggggtgaagggttttctgcaccacactttgaccacaagcatcaccaatttcactgaacccaacagaaatttggaccctctgggggctctctgcgtggcagggcccttttctttttctttgggcttaggctgcaatttgaaacaccactttcctgagccagcatcccccttgcagcgctgtcacagggaggcttaggcagccacgtggaagccacctaccccgacctttggcagaatttccaaacacaacacagtagctttaagttgattaatttggaactctgaccttggccccaaaaggtaagaatacataacaaggtattttattctcaaaatgtgtcaggataagaagcacttctgtaaatcgacctttttaaaatagatataattagatttgcagttgggggcagtaaagaaagggtctga

SEQ ID NO: 572 - DNA, 500 bp, Homo sapiens
ttctaaattatttggaatcagttaattcttccccatctcctacccatgcctgacaccaaagaggagcctctaaatttacagggaatacaaggaagtctactgttctctgctcctctctgggttattagggcacatgggagccctcagttgttttctgctgagcaagagcaaagtccaccttggacttagacagcttgccaaattttttgccagaaggggacctgagttgtgaccactcccagtgtgtgccgggaaaaggctcgtactggtgccagaatctcttactgtcaatgctcccaaaactcaccgcttgcccccaccccttttgcttaaatgacgtggttcttatctcagatcctgatataaagctcctacagctacctggcctgagaagccaactcagactcagccaacaggtaagtgggcattacaggagaagggcgtctctaacatgcactgtagatctaaaatcttcgggaagatacagcatgagtttctgt

SEQ ID NO: 573 - DNA, 500 bp, Homo sapiens
aagccagggcagttctgatgacttcacatttcattggtatttgtttttcatgggcagtttcatgctgtcacgttgcccttcagagaatcagggaatgccttcgtagaatattaacgacaaattgttgaatttgcacagcttgttttgtctccctgaattagtatgtgtaagaaaaaccaatggaagattttagcaggctctgaaagtagaatgcccgctgaagcaaacggcagggttgttcttccaaggcgtattaaatatgggtacacttagtttgcagacttggtgtgctgcagaatatcacatatgaagatattttgaccgctatttagaagagtgacctcataaatcttttagcaaagtagacacacatacctaccacatttcttaaaagtagattcgtattttgatttgagattgttgaaaagcatggtatgtttggagtgcacttagttatgtcccatctcataaagactgttgagctctctgcactgctgatg

SEQ ID NO: 574 - DNA, 500 bp, Homo sapiens
tgagaaagagataataccttgtaggcggaggcgtccacggaccaccccagaaaccactccaattactggatttgcaagggaaaggccctgccccacacaccctcaagagctgttcagaacttacagggctcgtggattccagggtggtcgctgaactccagcacgtagaggtgtctcccctccacgctgcgcccaatgctgtagacccgcgtgatgccggggcattcgttttgcaccttgtacagcgtccgcacaagatcatcatagcggtggtggcgaaaggtcaccggggcaaccaacttgaagagaaggaggaggtggaggaagactgagagcaggtctgacatcttgctgggctttttcaaagagagccactgaaacgcgccccacctccttaaacaacctagcctcttcacccgccaaaatccaaggtccacctagcttcccgcttgtaaacaccagtccaaattggaagacgttcccagctgtccgtccaaggc

SEQ ID NO: 575 - DNA, 500 bp, Homo sapiens
gacatactatcagttgttaatgagaaagtaaaaagtgtaagaagtattctaaaaataacagatgttctttctgtattcctatttgtgatttttttttctttattaaaaagaacctttgtgtttgcaccctggcgggtttcactgctctgaaaaagggactgatgtaatttaaagttagttaatatttaaaaagcggttcctgcccacactcagcatttgtggagtcaaacggaggttgtgccggtccgtcgctgagacttatctcaggaagcgcacaggcacggtgctcgccctgagagtgagaatcgcttgaacccagggaatgaaaaggttattatccctgacttagggcctattcccttccccacttactgttacccttccctcagaaacattcacagtcgaaaatgaggattgagtgtatctcgtgagaagaaccacctggttctcccgcagaatcatagcccaggatgaaagcatttctcccactgaaagttgaa

SEQ ID NO: 576 - DNA, 500 bp, Homo sapiens
gacaaagaacaaaagcaattgcttgacgttataaaacccactggcttaaaataaattgtttgctgagtagcaattttctcatggttttaaatgaaaagtaaacctatcccttttttcaaaaaattagatatatccagtcttatgtaacagcatagaactttattttctactaatgcaaataaatgtccttcacacctagcagaccagaaaatcaccaatgaaatcttagtttaattattttcctgatagcgacttggaatcgatacatcaactaaatatcttctgccaagacttaatcgccatcacatttgcttgtttttatgtggtttcaagcaatcaaaagagagaggaagaagaggtaaagaaataaattcattcatattgtaatgacaactttaaaaaattacagattcaatttgtttcaagaggaacaaagcaaggaaaggtaaatgaattaagaacacaaacccgggtatgtctcatttctctggcattctttt

SEQ ID NO: 577 - DNA, 500 bp, Homo sapiens
tctttctctgccccgtgtctgtctctccttgtctccccttccgtccattcccctctgttcacctttctgtgcccctccgtccattcccctctggccacgcatacctggcccccagcggccccagggctgactgccaacaagccgccagccgcagctgcccgggaggtgctggctcggctgcacgaggaggcgcagctgctggctgagctgtcagatcaggctgcggctgtgacgtggctgaaggatggtcgcacactgtccccaggccccaagtatgaggtgcaggcatcggccgggcggcgggtgctccttgtgcgagatgtggcccgggacgatgcaggcctctacgagtgcgtcagccgcgggggccgcatcgcctaccagctctccgtgcaaggtgggagcagctggcagcctctgcggggttctctgactttgtggggagggtgagggacagggcagtggaggcgagcccagcttggtagggggagggactccat

SEQ ID NO: 578 - DNA, 500 bp, Homo sapiens
gtggactgagccaaagttagaagaattctggagctaagcaaaaagcgacacgtttaacagcccccattaattggggctgttacatgattaatttgagaaaaacagaagagaccgatttctttacaactcacagttggatgcaacgcactaaaagtaatcctgtaaattacattttaaatctccaacatattccgagcagataaaatagtggcatgattgaccaaactccttttaaaagtacacatattacgatgcatcatagttataaacagatggtatttggcctccttcctattctcaacatttggaatttctaaactatgtgaattaaacaataatattttataaacatacaagggattttgctcactgctttgttaacatagaaattatacaatgctgacatttatttaaattttaaaaagtaaacaacagtgtgcatcgaaataaagcaaactaaaatcaacatagagaagtatgttctgtgtgcgtactaccta

SEQ ID NO: 579 - DNA, 500 bp, Homo sapiens
agttccattggactaattttaacactcttaagaattgaatgctaagaacatcctaataaccacccaaattttatttattctgtgggatacccactttccctcacttgttgcaattctgtgggatacccactttccctcactcgttatcgtccttctttgttgtttctgtgcataaagctgatagtcattacgctattgattatttaagaaaacaacccatcttgagataatgttgctggctaacattcccggagttttctcgaaaggactttttctatcttttacttaattactttagagataagaacttcccaaatagctgctataacttcaccacatagatgagaaggcaaattcgctcaattgtatttaatgtagggcaagtattcttagacattttggggtcacaaatccattgcaaaaatgatgaaagctccatccctagaaaaatgcactgattcataacattacattttatgtaccatttcaaagattttgta

SEQ ID NO: 580 - DNA, 500 bp, Homo sapiens
tgatatctcttacttagggatttagaaagtttttatgatgcagatcttacttacaaacagctacttttcagtaaaggaacagaaggacttgggatttctcatgctacatcaaacagcaaatgtattttatttgcactgaactgtattaagaagtctctgagaggagtttactctttttggtagttaagtgcatgattgtacatctctctcttggaaggcgggggtaaaccaggcaccaaaccaagacagcgcctacctccggcgtgccacagaaggtggatgttgtgctgttgtgttcaatgttctccttgcagagtccgaagtcagtaaggacaatgtgtccctgtgaatctagcaaaatattctctggttttaagtctctgtaaaaaagtgaatagaaaagtagttgcacaagttaatttcacttcataagatatcctcttaaagataattgctaaaggtattagaggcattttaggttcactgtagttgtgtagtga

SEQ ID NO: 581 - DNA, 500 bp, Homo sapiens
ggcctgcgtggagcccacggacctgctgaccaccctctccaacatgctgcctgtgcgtctggccacggccatgatggtgccctacacgctgccgctggagagcgctctgtccttcaccatccggtgtgagggctggggggtcgggagaggggcccaggggacggactttgggatcatccgcgagtgatggttaccagggaaggtggggtggggtgagcagtgccaagtcagggcacagacagggcccggcgggtgggcatgtgggtctggccaagtccctgaacgcgccgctcgccctgtccccagcttgctggagtggctgcccgacgttcccgaggacatccggtggatgaaggagcagacgggcagcatctgccagtacctggtgatgcgcgccaagaggaagctgggcaggcacctgccctccaggtgagccgccgaccgcgcgtccacccggggcccgcggtgctagcgccgggagctgaagccctccctgccgc

SEQ ID NO: 582 - DNA, 500 bp, Homo sapiens
gcactcaatattaaccatcacacatgcttatttggtgggaacccttctggttgggaagggtgttttcctgtacaataggttagaaagcttgatcatcaacatgtaataatttgtatttattattgagcacaatatgacttttgttatttgcttttgaaagctagtactttggttgcataacatctgtcatttttaacttagtaaaattcttttccagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtagtgagtataattatttgatataattatatattgtataattgtataattttttataatttttaattgtaaggaaaatgtctgttttatttctttgtatttacttgaaagaacactaaacttttttcct

SEQ ID NO: 583 - DNA, 500 bp, Homo sapiens
tatgtcatgcattttaagaaaattgctaatgtctactttttggccttaagttgtagttgtgggaggctgcttcagggggaggtgtctggaacaaggggctcttctgctccgctaagctttggagcaccaagttcaggctttgtgtagataagctcaaggatttttcaacaggggtgggggagtggaacaatctaaatttaaactatagaatcaacattttctttaaaaattgttccagttttcaagaggcgtaggtggatcctgtgaattatgtgataatgcacacgcttttcctacatcctgcttatgtcaaaacatttccagagactttcattttggaggttttattttcaggctacagaatgggctgggcgctcccttttttatctcttatgcaaagaattttaaggagtcttaggctgactttttaatatgggaagctggtaaaggtcagtgttcttatgtgagcactaaagatatttaaatttgatatgtaataa

SEQ ID NO: 584 - DNA, 500 bp, Homo sapiens
ctttcccaaccacaaatactgattctaagctgctgccaccacaaagcgacttagagtcgtccccctgaagaacaatgtgctggaataccaccagatggttcctgagtaagcttgttcatgaaacaggtttccagttgagccatgtgaacagagacccgccgcacacctttaaatggtatacactccaagtccagaagaataagcatgtagctttgcttatgtttatggagctggagcccagggatgctccgattggcaggagtcggggaaagatcagccaatcaaagggcgcctccatttcagggaaactcctgctcatttatttagcatcttcagagatcatcggcttttccaggaagagcttttctcttagagtatcacaagagaaaaataataacttcgtttctattttagtgtcctatgctcttttgtcaataaacccatagctccccgtcttggtacttctcaatatatcccccactttttcttataaagaacta

SEQ ID NO: 585 - DNA, 500 bp, Homo sapiens
gagtacatctgcacagcttactgctcctccaggacagctctctctattgaacccagcctcattacagttttgcaaaagaggtgaagaaaatcaaaatgggtcaatacttttgaacaacaattttgaaaaattcccagaaaatagattcgatactataaatgctccagagcaactgagaggaaacacttaataaaaatagtcatagtctagagctagttcaaattcatgataaacaaagccaacccttaccgtgacaactgactgtggcattggaaatcactttgccaattcgaagcagctacgggaagagagtctgaagccaagcctccaattttatcttgaatatataaaaagcaaagtaatgccaagaaattctgcagatgctagtttcatcagatgacataaagactcatttaatcaaaaaggtgtcatttagttctagcaatctagttggactactacagtatatgatttccgtctgtttgaggtctctaagcagt

SEQ ID NO: 586 - DNA, 500 bp, Homo sapiens
gagtttgacaaggtgaaatgttgttaaggaactaaaagtcaggatcatggaaacacctcaccggagatatatttaattaaaatgactcatcctaagagcaaaaaaacaggtaatttcgtagattgtcccccaaactttgttctctccttaccaccaaacctcatgtggtcttaaaaaaaaaaaaaggtcttgacccagagtacatagaatgtggaaaggcgtggtacccttttgcattttgttattcatcgaaacaccagaacaggcaggacaaagtttgcaagcccaggagagactttcaacagcaaccttatcttgtttgaaaatttgctctgaggtcacatggagcaagcgagagctcagctgacagtgtgtcgaaaagcctccagctagcgaaagaaagcatccttgagtgcaaaaaggtcgagcatctttggaagtgggtaaattggaacaatatgatatgccttgtgtaaaaacatattccattttctaacttt

SEQ ID NO: 587 - DNA, 500 bp, Homo sapiens
tggcaggcagcaggccctggggtcaccagagccagtgggacttgaccccagggctggggccgccatctcccctagctcacccagggacatcccagccccaggacggccaggccaggtgcaggcgtccagcccagcctctggtgaggcctgggacccgctggctgccactcctccctgtccttgccgccgtccccgtcggcacacgctgctcgtggtacagccagagctctccctggccagtcccggggccgggctcttaaccctcgcggagcctccgttactgcacatgtgagctgggtgcgagtcccttggtggctggggggagagagcacgtgtagcacatgtggactccgaggcccttggctgtcaccgccgccagccttagtgccgcacgcaggtgccgccggcaagctgcagggcgccctgatggaggggccgcagcaaagggcaggtggaggtggactttgacccgggccggcttcccggggagccaggctcct

SEQ ID NO: 588 - DNA, 500 bp, Homo sapiens
atgaatagtcctataagaactggatcttctgatttgtggtgaaatcatttaaggagaataaaagcgatatgttaattaaataaattcaaatgatttttacaccaaagtaaattgaaatgccattccatactctactaaacattcataggcaatgttattgcatacatacttattcaaaagctatttatttctaaggtacttaccccaaactgacttctgattattcactggaatgttacaactaaaatacgcttgctggaaaactcttgtacataaacacctgagcgatcaaggccaactccatttatcttgaccattgcttgattaattcctctagaacaaaagcaggtgttcactacatttgtattaagaactaacacaatcgggttaatgatcaactgatgaaatgtgcaagaattgagaaaaaaacaattatagaattttttaaaagtattaaatttatattattattttatccattattttgcttcttttaaaag

SEQ ID NO: 589 - DNA, 500 bp, Homo sapiens
acctgcctcggcctcccaaagtgctaggattacaggcgtgagccaccgcgccgggccataaggtgctttcaaagtattttaagtaactcatatctttattgtctctgagattatttttattgatttatgcattcctagttaaccaagcagggctctttggcatgcaggctagatagtgctactgagggaactaaaagtatatgaaagttacacatttagaggtcaaattaggataagatcaccgagggccgattgaaaacatgactatgtacacccgtaaaagaaaaccttgttgggctgaaatttatgaaaatttatgctttgattgtgcctttaatcatggacagattgtagctagcactgcatcattcaccatattctattactccagcaaattggcatcatagtatccctccaaactatcatagagacagcctgcttgacatacatgctgtgggggtgaccctgggcaagctatactaagtttccttgttgtaaat

SEQ ID NO: 590 - DNA, 500 bp, Homo sapiens
tgcactccgagcaacccagtggagtcttcaccaaaacaaaacaagagcgtatgtcaggccaggagcctggcttgtccctggcacaacatcatttctgtttctcaaggagcaactgtgggaagactgtcactgcagctgctccagggcaaaagaaagtctcaagagtcctttaaaacaaaacaggaggaattgagctgatgggaaagaactctgaatgggaatattcctaaacccattaacttatttattcgggtgggagggaggggaccgcgggagggagaggagggattgatcacaggcttcttttatttccactgttaatcatccaccttcactatactgttgttctgtctgctttgggcagggtgcaggagagagaccgtgtgccgtggggctggtggcctgctcagggacagccatggggacctggcagctcaaaacagatggcagcagaacaaaagaaacttttgctttggaagcacagccaaactccccagggc

SEQ ID NO: 591 - DNA, 500 bp, Homo sapiens
atgtataactaataaaatgaaaggcacctctaaaactggatcttgaaattaaaagctactattcagtggtgaaaatgatgagaacatatgcaaagagcaatagttcactcagaaacagctggtcttttaggagatgagaagttcacttcatacttagacaaaaggcatagtgtagtgctacattccatcccacctgctacactaacaaaactggctctactagacaacatccatatttgagaaatattacgtacagtaaaagaaaaatcacacgcttaaaactgacagagggggaaagtatttaaaattaatttacattaaaaaaaaagttgaaagctaacatagaatcaataccttgggttcttttttccatttccaaaacgaatgtgagccagattcaagattctctgtcagcactacaccaggttttgtcaatttcactgaacacaagatattttaaagtctccaattcgatataattcatgctgagttctttaagt

SEQ ID NO: 592 - DNA, 500 bp, Homo sapiens
tgtccggggccgaggtgacaccgtgggctgggggggcggtggagcccggggccggcctggtgtccggggccgaggtgacaccgtgggtggagcccggggccggcctggtgtccggggccgaggtgacaccgtgggcttggggggcggtggagcccggggccggcctggtgtccggggccgaggtgacaccgtgggctgggggggcggtggagcccggggctggcttgttgtccggggctgaggtgacatcgtgggctggcggggtggtggagcccagggctggcctggtgactgggaccgaggtgacatcctgtccccaggtggcagctgaacctgaagctggttccgtggccggggccagagtgacatcctgtccctgagtggtggaggagcctgaaccggggctgtggctggagagtacgctgctggtcatactcacagcattcttctcagtagagctgggcactgaacttctctgggtagccgaagtctccttttct

SEQ ID NO: 593 - DNA, 500 bp, Homo sapiens
cgctgtcattaacggcagagaaagctctttatttccttttgaattttaatactgggtagaaatataatttacaatgaaagtcagcaggaaaggaaaaatactaaaaacgaggaggcataaaaaatggaaatagatccctgtagtcaattttctatcatctataattttctatcatctatatgtgtgttacccatatgctggggtggagtggggaggggagagggaggcgctgtgaaatacatctgcctccgatcacaaaaagatcaaattaacatgtgaaaagatattccaaggagctgtgggagagaaaggcttttggctttcaccatcttacctactggatgggtttgaaagcataaaataaagctaaactaaattcagggaaacattgattcacccaagtgaataaacaacttactgcatttgctaatctaattaatcaaactctgcttctccttttccaaaggagattcacaggcagtaaaataaattaaatcaac

SEQ ID NO: 594 - DNA, 500 bp, Homo sapiens
gaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttat

SEQ ID NO: 595 - DNA, 500 bp, Homo sapiens
agggcctgggagcttgctgcagcttcaggtgagtttgttcccaagccctgcggctcgtttatgggtttgcttgcgctgcagaactgtttgtggagcagcagggttggagtgcccacggctggggggcctctcggagcccttgattcacagaacccctggaggccggcagccctgcctgccctgaagagcctcgttctcccagccgtttgggccgtggtcctgtcgtgggaggcgacggtgagggcggcccggggtcccgacaggggtgtttgtccctttggggacctcccctgtgctgtggccccggcccccagatggagctccccatccccacggcagcgctggggctggggctggtgaggagcctgtgcacggcccccaccgctatcctcagccaggagggtgcctggtccctggggagcggcctgcacctgtttctggagaatgctgtcctgccagttgtcatttggggcgggcggtcggagtccacgtcctccccc

SEQ ID NO: 596 - DNA, 500 bp, Homo sapiens
aatgagactcgttcccacgcttgctgctgttcagacgcgccgggcatgctccctgctccgtacggaccctttgctctgccttctgccatctgtcttttaaaatgttaacctctgcaggctggaatgagtgtaaggtttacttttattttcattttttaaaaatcctaatctcatgtctccttggaaatgccctctcaaaaatgaaaagacactgctttctcgacataaagccatttgggatggtttcagcgtgttcgctggggcacccatttaccctgcagtaagaattctgccgtgactcgaggcagagcctccgcagacccccctgcctgcccctcgagccacgcaggtggtgggagctctggatcctctgtttacaaatcattaatgaagtgattgtggcccttttcacttgctcacacttttgaactgtgcggagtgacacattccttaatggggggacacaagggcagagagaagcccacaacagtcttattatg

SEQ ID NO: 597 - DNA, 500 bp, Homo sapiens
gaaggtgggccagcctggcaggtaggcagcaccacagtagtctgtcctcatgtggacccctagttccacagctctcccaccaggcagacacaggcagccagcagtcatgcattccacaagtatttattgatcttactgcataccaggccctcagatggggacacagccacgaatgaagcatggtccctgctaccacaaggtcctcttcacttacacacacactgaggactactgcttcgtcacgctttccgaagcagctgagtggggctatgtaagtgaccttgcagatgaagtcgccacctgcaagaactcacaggtgagaacagagggtggccaccaaaaggtcactgaactcccccgagaaaactgttgagccacacacatgtccaactttccaggtccaagacatactgcagtactgctttgtaatagccaccaggtgcaaagccaggaagaaccagagggaaacaggtttttctcacatgagggaagagcagcct

SEQ ID NO: 598 - DNA, 500 bp, Homo sapiens
tgatcattaaacaaatatcgaacaccaggaaggttattaacagagagagatgtagagcagaggtttagagaagtcttaaacttgaccctttcattgcaagtacctttgtaaaaaaactaactgctgagaatagctaagccatctttgcaattaagaggatgcatgctgattgccaaggctttgttaatctttaatttaattaaagaatttatcccccaaataggaaagaaagcagcggagcggctaaagcgtcatttgatttttctgtcgatgacttgagttgcctttgaagggggtgaatacattgcaggacaggaggataatagaaatttttttcctggggataaggggaaaaaattcttgaataaatggtctaagtaaaccttgagtttttgaagataacctatttactatgtttttaaactaaattaaattaatttatttatttttgagacagagtctcactctgtcacccaagctggagtcacccaagcccagcg

SEQ ID NO: 599 - DNA, 500 bp, Homo sapiens
atcgcttgaacccgggaggcggaggttgcagtgagctgagatcgcaccattgcattcgagcctgggcaccaagagtgaagctccatctcaaaataaataaataaataaataaatataaataaatataaggttagggctctcctcattttgccattgcccagcccagtgaaacattaacttgtttgattttgccagtatgtctctcacacgtttcctagtacaggtaaaacagtgttacttgccaccaaccgactcatttatttcgtaggcatttactatttgtattttctgtacccacccctgtgctggggaccgggaatatgaggaggatgaaggcaaagtgttaacaatttgctcccagagcaagtaaaccacctggaaaacacagggtgtgtaagtgccctgacgtgggtgagctcaggcgactgatatcctggaggagggtccctaactcagagtggggggagggatctgaaaaggcctcctcttttagactggca

SEQ ID NO: 600 - DNA, 500 bp, Homo sapiens
ttggcaaagcttttagccacagcaggagctccctgagtgaggggctgggtttcttttacctcagtattcttggaatctggcccactgcctgacacatagtaaatactccataaatacttgttaactgacttcagttaataattgtcatcgacagtcattgagagcacctaccgttttgggtccctgattaagactaaggatacaatgaagtataacaaacagtcctggctctgattggagtctagttggcgaatcaggccaaacacgataaatgacacttgccagcatagagtgatgtgttttaattgctcaaggaataacacaggccataaggggcactaatgtttaggaaaaacaagagatccacctaggacaagataccagggtcagcctttctgcttgctaggaattgggctatgcctttaaggaagagataatagcaagatgtatcaagtacctcctactctgtgctaatgtctctttacatacattactgaatc

SEQ ID NO: 601 - DNA, 500 bp, Homo sapiens
ctccgtctcctgggttcaagcaactctcctgcctcagcttcccagctagctgggattacaggtgcgcaccaccacgcccggctgatttttgtatttttagtagaaatgggctttcactatgttggccaggctgacctcgaactcctgacctcaggtggcctcccaaagtggtggcattacaggcgtgagctaccacgtccagccaggtgcaaagaattttgattggttaacagaaagcttgcctctatgcggtttggatacataattagccttgttacaaattgaggtaagactggattctaggagatgctatcatgggagctatagatacaaacaagcaagtaaatggcttagtatctaaccccagagaagagatatttgggaaacaagcctgaactacatggactacccccacttccaggtttaagtcattttaggcaaaaataagctctaagaagaaaatcaagcagatgtggtgatagagaagaaataagaggcag

SEQ ID NO: 602 - DNA, 500 bp, Homo sapiens
acctcaacactcagaatagtatctggcctttctcaggattttgctatgctttgaatgaatgcatgtcgcgacaagcctttgaagtaggtactgttattattcccattttatagataaggaaataggctcctagtggctaaagaattacctaagtttacacaacaaacagcaaaaccaggattcaaacccagtaagtctgactctagagcccactctcttacgcactacacctgcgatactgaactgcaccggcttatgctgaagtcaattattaaagatttttgcgggggtgatactaggagaaatttgagttgaaattccccaacctgataacttttctccaagttttcctgagaacacagctcaagcgcctcttcacagtctcctaggcacaacgatttggtttctcccaagtctctctcatccgcctcttctcctaacaatccagagataatgaactcttttccagcaaattctcctgcttctatccgaaacactca

SEQ ID NO: 603 - DNA, 500 bp, Homo sapiens
ctggtaaaagctcaggtaaagacatactgaagctagacgagagctaggatctctaaatatgttgaaaatgttatctgttctttctcaaatatgtctctcctattcaggtatttgctctgtgatagccttttaccttggcagccactgaggctctgtgccttgtatttcaaaactgataaggaaaggcaagatcctcccacactgttccctcagagcacttggtgaggatgggccatatgtgatgtggaccgcgtggcctcgctaccagtggctcacccacctcccccttcttgtgcatgccttgctcatctagagagcagaaggtaatgggaaggagaaaataaatgggctttctctgaggatctcacacaggcactccagtgatctccttatctgcagacttggcaaattctttacaacatctgatcaaggaagggcttttttgatgtttctgcatgttctcgatttactgccctgctgctgggatatgacgagatgcc

SEQ ID NO: 604 - DNA, 500 bp, Homo sapiens
cttcctcctccacacccacctctctcgagaccctgccgtctaccccctgacgcttcaggactctatggaggaagactttgatctcattattggaacaacctagatggaatctcatcggtcctcaataaccctgttttccctttcccactccgtttacttttcctctaaaagttcacttggaggaagggaagggtggcgagggtggtgggagcggcgggcggcggggagtgacaggcgcttggtccggcgcggctttgcctggttgtaacaagcgtcgggacatgcggagccacagaagccgggctggccacatcatcaatcacggcgctgacagccgccttcagtttgtttgttccactttgcataataagtgatcggatcaggtttaattagatattgggtaatcaatcattgccaacgaggcaactcagcttgggatctagatgctgcaaggggaaaaggcaaaaaaataaaaacataaaaaaaccagcaaatctcat

SEQ ID NO: 605 - DNA, 500 bp, Homo sapiens
gccccgaccccagtcctgacccacgtgggatctcccctaggcccgcctgcctcccgtttcccttctgtcaaacagggtggggggcacaggagcagagcccccacctctcctgctgccacatgctgggcccactccccgcgaccgcccggcacactcacatgctcgtgtacacgcgctggccgttctgctggttctgcagcctggtcttggccaggtcgatgggaaacacgcaggtgacaccgatcagcccggcgatgccgccattgatgagcttggctggcaggctgtgtggacaggggtgtcaggaccggcttccttgaccatgggtcagggtgggggtgaggcacgcagccaggactggagtctgacctgatctgcttatcagccatttaactcgattgcacccaggtaggagccgcagaggtggacgccaggccaggcggggtggaggtggaggtggaggaggccttgagggagggtgggacccaggggggttgggt

SEQ ID NO: 606 - DNA, 500 bp, Homo sapiens
ctacgcaaaagacaccttcctagtaaggcctcttttggccatcctatctaaaattacaacttccacctcagactaacacttacaatccttttattttcgttacttttatccttagcacttatcagtacctaacacactatatcattttctcatttgtcttcttacctggttccactctagaatataaaccgggagcacttaaaacaatacctattatgttgtaagtgctcagctaatatttgttgaacacgtgaatgaatgaaagattcctggcacaaagtgctaatcttcaataaatattgtttgaactgaactgaaacagaaaatatctacatagtcccctgtgtaagtactatagatgggagagggcatacatattgttacatgcagggttctccatagattatatgctctttcttcaataatattacgaaagcctacatttctcatgtgatgttatgtacctgtatgttaatatgtattatttgtacatgcaaata

SEQ ID NO: 607 - DNA, 500 bp, Homo sapiens
acttccacctcaggtcctggaatgtccttccctgagacactcaccattcactccctctctttcttcgaatctctgctcaggtatcccctctttgggcaaggcccttctgaccacccagaattccctaacctccaaccctgctttattttcctccataggaaaggaattttgtcttacttaatttaaccttagggcaatattgtcttagtctagaaattcagctcatggatacaaaaatcctctaggagccgtaacttcctgtcaatcctaaaatttaataaggcaaatgtttggcttcgagccatactgggaataaggtaaggccttttgaaaaagccacgatgcccaggtgagggttgaattgatcactgagaaccctacaaatgcgctcatggcaaggctgggaataccctacacttaccctctcggtcatttacttcagagtctgcggggcattctaatccgcgttgtcatttgctttgtgccacattcctaagagg

SEQ ID NO: 608 - DNA, 500 bp, Homo sapiens
ccgtggaatcagaatctgacagggaggaagagtgtgctcagaaaatgcatggctttctactgaagcagatttttttcccattacacttctagatctctgtgcaccattgtgccagggctgcgaggaaggtggcccacttcccgggatacactacccaccctcaagagagcctttcctgctgcttcttaggcaagtcagctctcttttctcacctcctgtaagcaacactaagtatctggctgttcctttcgtactcgagtcctggccgctccatgacagcacttgtggtggtactgaactgtgatggacactttctatcattgccctttcttaccttgatatcctaaaaagctggtggtctgtcttctctatcttttgtcctggtcagttatcctaactattttgtgtctgtttctgtggattagtaaacggggtccccacccccactccacaaggagaacatctggcacccagaagtcactgagagaatagctgttgct

SEQ ID NO: 609 - DNA, 500 bp, Homo sapiens
gcattaaataacacaatcacggaagcttctcaaggttctccctgcttttcagtctctcagcatgtggcttgaattttcccaaatcgcctccatggacaggttaactatgcctggaatgtgaagctttgacaaacttgtacacaatcaaacacctgcttggcatgtgggagggctcaatagaggcaggctgagtgagtgagtaaattagtcgatgatcgaatgaatactttctcctggtgacctttctttcgatagtcataaccggacacagagttgagcagcactaagcgcagtgcatcagtgtcgtttcaacaatttccacattctttctaagggctccattcttttccttgaaatccattcactatatttcccatttattttttctactgatatttctgcttctctgatgtctccttgaacaattgagctgccagattaatttttcaggagtgcaacttccatcccagaattatcaaatcactcactcaaaaacttct

SEQ ID NO: 610 - DNA, 500 bp, Homo sapiens
tgggcatcagcctgggcgcaccgtggcaggcatgtgtcccaaactgctgcggcggtgccccagccaacacccccacggccccacctgagctggtttctgtggtggattgaaaagatgccaccagaggtttgtgtactttctcctggaattacattattggagcttttctttttaatcagcgcataggtcaacatgctgtcaatgattaatgtttgcggcatgactaaggtgcttgacagttgtgagctccgccgtcaatgctctctgagacggagaagaccactgggcctaggagaggccttggcgccgcgacctgcacgcccgctatgcgcccagatcatccgcagctgcgggaggggccgtggccagtgggtgagtggcagcgtctgtgagcagcacagagcagcacaggaaacgactccagcgcggccccacggcccctgcacgcgtgcagacctgctccgaggttctgttctgatgcttgcctccctccttcgcaa

SEQ ID NO: 611 - DNA, 500 bp, Homo sapiens
gaaaaagcgtcagaagcaggacttacaattaaataagaaaacaaagcccttgttctctccctcctcttccttgctgaaaacaaaagaccaagtctactggaaaacatcagtgcaattcaaaagcaggtgtatttccacatgcagagcagcttgtgggctagaagcagatgccagtggttacatagtagcaagggttttagactacactctcagggaaatgttccaaaccatccaaggtgacctcttgcgcgcgcgcgcgcacacacacacacacacacacacacacacacacacggtagaagctaacatttggcactctatctttttctttgtttgtttacggcctaacataccccaaggtgttccagatactcatgctgctaccaggtaaccaggccaccacactgccatctgttttagctccaccctaacttaacagtgcttttgtgttccagaatttcccctacctccttccactcctgcatctccagattcatttc

SEQ ID NO: 612 - DNA, 500 bp, Homo sapiens
aacagatctgtgatatttgacccgctgaaagaaaagtcacactgaccctgagatccccccatggtaaggcattctgagatacctgagctgtctgcagacactgaggctggaagcttttttttttaatttaatacaatcaggatcagggaggggggatgccgaggtaaagcagtgcacatacctttcaactggtcagcaaccacgctctggcccagccgttcaataactttcccatcttccatttcgtaccggtcatctaagtattttgcggtggcctcagaaatgtgaactttgccggccactcccagctgctccatgagattggccaggttcacatcgttggaccacacgtcaaatttaaacctcctcatgcccaggatgccgcaaaggacggtgcccgtgtgcaccccgactctcatgttcaccatctccttcttctcctggcagaactgctcgatggccttgatcatgcccaggcccatctcgatgcagcagtaggc

SEQ ID NO: 613 - DNA, 500 bp, Homo sapiens
ggaactcatcaaaacagagggcagcgctgaagtttcattaacagatcatctcggatctcctgctgtgtcctgtcttcattttcttttcacatcatccttttgcttagagctctagctttagagaggaggtcagagccgctgtaatggcacatttaccattccccaccatcccccagattaatattaaactgttaaaagaaaatgagagtttattgattgttttaagccaggcatgttctagcagcgagccgctattcagattcagcaagcggcaatagataactgatttcaataagaagacagagaggaatgtgggctggggatcagaagggagagagaacaatggcccaggaatgtttaatctttcttatggcactaatcgttacttttgcaatttgtgattgtttatagatcatttcttttaagtctgggtacaagattgaaaaatctcaatctagacacttagatttctgcaggaacagtgtagggtcctatttaat

SEQ ID NO: 614 - DNA, 500 bp, Homo sapiens
ttctttcttcctggccagggagggagaagggggtgacgttttattgagcatcggctagggccaagctctcaattaggccctttcttctttcttcttagggtatctgtgagataggtgctgctgtcctggggaggtagatgcagacagattaactctcaaggtaaatgctaatgaatagaggagccagaatcccaacccaggaatgtctgatctcggagtgggcggcttcccagctgtggctttgcataccgctagcgtagccacccggaccctgatcccctgacccttgtccttgatcctccaggaaattctcatatgtaacctggaatccactttaaatgaactcggtaaataatgtcttgactctaggccagtcattacctgggacaggtgagggggaagggcaaccacctgactatgtcactgtcaacagtgcatccttgggctgaggttttcattttacagtggggttcaggcagggctaattgctgacccaggac

SEQ ID NO: 615 - DNA, 500 bp, Homo sapiens
ggttctgggcagaggatggggcttgagggcagagggcagcttggaggagcacgcccgagtggacaggtggggagctggaaggcttagcggggctccttggagagcagcgctgtccctgggcaccacggaggtggttcctggccagagctgattctgtcctgttcaattttgaactgaagtgcaaacaagcctcagcgcccgctgctcccaccccaaatcgaattcgtgctaatatttctctgggggcggcgggctgcctgccttccggggacggagggcgggggagactggcagggaggccaggcccaaccacggggctgccgggaccaggccatgtgtctggggcggccggcttagctggctgggattgtccacccaaattaaattttaacccagctcataaatcttccactaagtacgtcccctgccgcccgcccgggtccaccccaggccgcagcgtgggccagcacagcgacagccttgttcctctgccccacatg

SEQ ID NO: 616 - DNA, 500 bp, Homo sapiens
acccagggtagagtgcagtggagcagtcatagctcactgtagcctcgacctcgtgggctcaagccatcctcctccctcagcctccagactatgggcgtgtgcctaaaaatgtctatttgatgtagcaacatgagataaatctggagaaacaggagggaatagttgttccgatcattacttttacattattataactgaatacattgttattttgtaaatgattacagcctggaattgaatagggggaaacggaagcagttgttacaatcattatcaatttgaaagtgaagacttcttttctctctctttttttttgagacagtctcgctctgtcacctagactggagtgcagtggcgtggcgatttcggctcactgcaacctccacctcccgggttcaaggagtctcctgcctcagtctcccgagtagctgggactacaggcacacaccaccacacccggctaattttagtatttttagtagagacaaggtttcgccatt

SEQ ID NO: 617 - DNA, 500 bp, Homo sapiens
ggccccaccagaggttctggcttcttgggtgttagggcagcaccagtgtcagcatctcaaaaatcactccctgagtgattctaggatgaggcaacatttgagaaccattgaactatactatcatttcctgtgccaactctttttaaactactatctgtaaattctcatagccgttaaggggcttagacgaatgacaactccatgaccttacatgctgccaaacattgattaagtagaaacatgagaaaacggccccctgttcaatcaatcttactggagtttttcgaatgatcacctagggctgtttttacaaatacaccagctgtgaaaagataacaagaaaaggcaacaaaacaaaacaccaccttgtgcagacttacttgcattcccctggtttgtcacaaaatccatgctgctcatcacatccaggcaggcagatcgctacaagcaaaggaaaaacagggtcaagccccacgccaagtacgtcccaacagggctgc

SEQ ID NO: 618 - DNA, 500 bp, Homo sapiens
aatgtgctcttcaaaaagcttccagcgaacagtgtgcaataagattgctaagcttccagagatgtgcaaattctcttgtaagatgtcctgtcagctggcggctccaccaaaaggctaactaaaacattcggaaacacacataaaatcctttaaaaccaagccctaacagggttcagaggaaagagtccgtgggaggcgcataggaaaagcctaggaaagcctcggcagcttccttgacgctggctgtgacgaggacgctgtcaggggacttgccaatggagttggggacaggctcttcggtaaactcggggtcaaagtgccgtaggtcgttgggcccactctgtgacgggaagggaaaaacactcttgtcaagaactcacactagacacaggacagggaaatcttgaccaggctttaaataccaagtttaagtcttatatcaacttccataatcacccacttcaagcacaaaatctcaaaaggctacacacagttaaaca

SEQ ID NO: 619 - DNA, 500 bp, Homo sapiens
gaccattcgcgggtttgcaggggcctctccccaggcattgtctcctccagccccccaccccctcctcggtcaaggcccggcggcagtgcttgctggggctcggagtttgtccccgctctgctgcctgttctgttgtgtgcactggaatattgatttttcagtgtgtgtgcgccggctctgtaaaaatcaatatttcagtagctcgagcacagcgcagggcagtgtaatggagccagcctgctgatgtaacgtgcggggtccaccctcagcgattgaggtcagtcagaaaatggcagtgttttcccatttcattgtttgcttcggagagaaggaaagagtttgcataccgttgtgtacatcagattccaggatgaggtaaccttactactgttgggtagcagacgaaccaagttagaaaaaagacaacgaggtgatgatggaaaacctccggttatcctttgtaagaacggatcttaataaaatactgggggaggtgggga

SEQ ID NO: 620 - DNA, 500 bp, Homo sapiens
ccatgttggccaggatggtcttgatttcttgacctcgcgatctgtccgcctcgacctcccaaagtgctgggattacaggcatgagccaccgcgccctgcggagtagaagttctttggataaacacattctaggagtggggtcaaaatgtgcaaacccacacgtgaagaagatgactaataaattgtttctccaaagagttgtattgatttacactgccaccagcaaaaaagctaatatatcaactgaaccgtgtttctaacaaccatttactgaatgcttatcatctgtcaggtgttgtgccagaagaatggagtttgtctataaatatttcatcatttcgagtagtgcagtccaacagaactttctgcattgatggaaatattctatatttgcactgtccaatagggtagctattagccacatgtggcttctgagcccttgaaatgagacaagtgtgactgaagaactgaatttgtcatttcctctaattttagttaat

SEQ ID NO: 621 - DNA, 500 bp, Homo sapiens
gtcctgcgctttgataaatggcaaagttacctcgttaatgagcactgaacagatccggccactgtccctgcttgggctctgtgctgggcaggaagcggttttctcccccgaggccagatctcattttcatgactgaatcttgtgagatcttgaagcactaaatcaataactcttattcagtcagccctgaaaggaaggcagttatcaaaaggaacgcaggcaaagcaggtgatagcagatgaaactcggcgattattttcaaaagaaccagcaggctctgaagtctgcggatgcttctctggcacaccccaaatcttcccctcacatccagtttggtgccaagctgtgcctgtcgtcagtatagcgtgtacaatttagttgcttgaagcagaaaaaatgtgaaagtggccaatcttatgtcttacttacctagtcaaaatgcatatggaaatgcaaagtgcttatgtctatattaaaaagaaaaaacgcatccagcacag

SEQ ID NO: 622 - DNA, 500 bp, Homo sapiens
ttcaaacaatagaggaattaataatagctatggctcaaaatcaatatatataatgcaatgtgtttgtgtttaaactagctcattaagattaaggtaggccaaaatactcatttccaaacagtaaaacaacatttccctgtattttagaggaaaatctgttaggctttatgagttaattatgaaaacatacacgtgtttttcaggttgtccgggtgccaaaaagcatgagtttctgaccagcgttctggacgcgctgtccacggacatggtccacgccgcctccgacccctcctcctcgtcaggcaggtacgctgtgttcgccgtgggacaacaagttggcagggtcccagaattctggggaatctggaaagtctgaacattacatattggcaaccttctcagcttatttggacacagtagggccttaaaaaggagccttctgcaaacacaggaagttgcttagcaggttttcttgtagcaagactaaatcactgaaaaca

SEQ ID NO: 623 - DNA, 500 bp, Homo sapiens
cctgccatcacgcccggctaatttttgtgtttttagtaaagacagggtttcactatgttgcccaggctgggctcgaattcctgacctcaactgattcgcccacctcggccatgatgcccagctaatttttgtatttttcataaagacggggtttcaccatgttggccagactggtctcgaactcctgacctcaggtgatccacctgccttggcctcccaaagtgctgagattacagatgtgagcaagcacgcccggcctacttatcattattgatccctgacatatacgaaggggttggatatattaattattttttcaaaagcaaaaagtacttactccgtcctgcaatagcaacatggcagagaaaactcgagaacaagatgagcactggagaaatcattgtggatgagtcacactggcactaccaaagtggttttcgtctgctaaaaagacagagccaaatatgaaagcgcttaaacattaaccattttctggtgta

SEQ ID NO: 624 - DNA, 500 bp, Homo sapiens
agttccctgaaaggggaagaataaatgttaattacctacaggttgtgttggctccaggtttccggcattgtgcctgcacggaataaaagcaagcagccccagcttctcggggctgctctctggccactagagccaggtagtcatctagctgctgttacactgcatacctgtctgactactcatttcatccgtaggtcggccagggtctacgggacacacccagcagcccaggagatcctgctaggcgagcgtatccagggactgagtcagagaccatttggaaaaaactggaaagaagaggtgagcacaggcactgccatattgagccccatgaattcaagccagaatgggacccccgccatctggaaaatggcattgagagagcaagcagcctgctggctctgcctctaattagcagtggatgagtgacctgaccctctctgaacctcagtttcctcatctataaaatgggataaaaaagaatagtatttacttcacaa

SEQ ID NO: 625 - DNA, 500 bp, Homo sapiens
caggcaggggactgaaagcaaaattaaataatgaacaggccaagggcactgggggcaggaatctgaagtagaagccttcagagcaagcactttgataaagaaaagaaaggctaccgaaggaaaagcaattaatggggaaggggctggtactaaaatgagcccagggaaagctgctggggacaggagggagggcagggtgcactggagagtggtggggtggtggtgggggaaccaacgtgctcgccaggccgtcattagcccagaattatcaggcacctgaaacaacaaggtcaagaatgtgacctgaacgatagatgaaatatttgtttaggaagccacatgctgggagaaagactcaaagagttaaactggggtgcttaccttttctgattgtagaattaaacaacaacaaaaatacaagcaaagcctatagattcattttattaatgtcctgaagaaaactgatcagatactgagtgtggggagacagcaggctctgt

SEQ ID NO: 626 - DNA, 500 bp, Homo sapiens
cccaggctgtagtgtaatgggtcgatcttggctcactgcaacctctgcctcctgggttcaggggattctcctgcctcagcctcccgagtagctgggattacacgcacctgccactacggccagctaatttttgtatttttagtagagacagggtttcaccatgttagtcaggctagtctcaaactcctgacctcaggtgatctgcccgcctcgatctcccaaagtgctgggattataggtgtgagccaccgcacctggccttatctttagatttctatcttggctggataactggcctaatagagcagccacatatttgctgagtgaatgagtaaaaaacacatagagagttggagagaagctgtgacctgccgtactgggaccatccaacactcccaatcataaatcagttgcagatgttggagctcataaaccgataacacaaaatacagtgccttgagataccgaactgcagaagcctaagggtctgtctgatctcc

SEQ ID NO: 627 - DNA, 500 bp, Homo sapiens
tagtggccgggtggcactcgggctggggtccgggggagtctaggtggccacctggctgtgtgcctgtgcctgcccaagctgggcacctttccctggcagtgcctgggaagctcggccgccctccctggctggtgctgctctgcagccccgctcatggactcttgcccacggcctgctccttgtagcagggtcgggccgtgggaggtccggacaggatcttgaatggccctgtctgcggtcctggctggccggaggttgaccgcactggacaggtcaagggccttaaaccagggtagtgaggagcctgctgagcccctgctgctccccgggctgcctttggcgctcggacagacacccaaggacagaagctcggacagcttctaaggcgaagggtctcccggggctgatttcccgggactctggctcctgcagagagggctggaggcggggctctgtgttccagggtcagagtcctcctggtggaagctgaggtgcctgat

SEQ ID NO: 628 - DNA, 500 bp, Homo sapiens
ttaggagagctgttactttgcatttaaatagccgcatttaagaaagcagcattcccaggatccttatttgatactaatgtgctgaacaccttaaagcacacttacttctcccccattcgggtcacttggagcttcattacttaataatttgaaagctttttatggaaatcagttgataaagggagatgatgaagtgaaatgttattacatttaaagacccagcaaactaggctgccagaataacacctgcgtcagacatttctaagtaaagaaagagaaggagaaggagatattggtgtgtggatgaattctcatttcttttgaaactgccgttactttaaagatactccttgcctaacaaagcctaacactctttaaaattgtcaagtgaagaactcatcagctatcttatgaattctacccctgccatggcgctctgtccccctgcccaccttcccagccgctgccttggcttcaagcccattgggtctagaggtccg

SEQ ID NO: 629 - DNA, 500 bp, Homo sapiens
ttatgcctgcacattttatctaatcagaaagtaagcctgcttgctttcactgagcagggttaacctaataagactgctgcttaaaccacatcgaaacgaggcataacaagccagcttgatgaaaacgctttcccaatctgtgacaacgcacttgaacgtcgccatcaaatcataacccccaaatatgtattttcccattttaggggagggcgccggcagccagccgttaattagcatacttcccatgctcgtcatgaagtcacgggctaatctggcacacacggttcggaacaggctcctgcctgaatcaatcgtgagagcagggcgctgggccctccctcccagctctccctttatatttcaatagtcctatgacaataattgattgtgattcactcctgaaatgtaccaatccccgggaaatggcatgggctttcattcatcaatttcagcttcataagtggaaatttatacaaggtatgcagatgtttagagtttgg

SEQ ID NO: 630 - DNA, 500 bp, Homo sapiens
agctgaagatctgcttataattcctcaaccatcgaggggcccatcatcttaagaacctccaggctctggggaactgaagcagcctaggaacgagcctgctgaacccccgagggttttcagtaaagaggctgccaagttcggcagctagagtttaaccagggcgagctatcagtattttgtattttggacacttgccctttttattacgagaaactgacacaatcacagtccctagtgtgttctaggtttcggtactgaacgacacaagatgtgcgccagattgagcgcaggaagaaagaaacaccctttagtgcaatacgaaatgtgactcagccagcggggagcgttagttattgatggaatggctgtccaccatcgagtcactatgcaaataagtgcttttcttgcattatcccagttgattctcccaacgaccctctgacagagacaccatcattcctataaattgcagcgcccctaggtagcttgcccaaagtccc

SEQ ID NO: 631 - DNA, 500 bp, Homo sapiens
cgcaggaggtcgcacagcaggttgctgtagtgggtcacctggctgcgcacgtcagcagccttggcctgccgtgacagtgtgtccccgatgaacaccagcttgtgggcgctgaggatgacgaacttgctgtgcgccacaaagatcttgggcggctggttggtggccacggcggtaaagaaggcgtccacggcgttggtcagtgtggtcaggttggcctcacactgctccaggtagaagagcagcagctgccggtccgagggccccaggccgcctgttcgccccggggccaggggttgggctggcgtccagttggccaggtcgtggtctatgggccgtgacacctcctgttccagtcgttcaaactgcttcagctggggcaggagggaagcaggagcagggttaggctctcgggtgagttggaactacaggccgagacctgggcaccctgggctgggcttctctaaaagggccgctactcagagtgcatgggactgcaggga

SEQ ID NO: 632 - DNA, 500 bp, Homo sapiens
cctctgcagagagttcccagcagcaagaaggccctcaccagatgcggcccctccacctgggacttccaagcctccataactataagaaacaaattcctttttttaaaaaaaaggaatgtattacccaaattcaggtattctgatataagcaacagaaaatggactaagacaagccccaaccctgccaatgcccagcacaatgcccaacacacttgtgcatgccagctcccaggcaacagtggcaatggccggaataaaaatagcccaggcccccaggatttgagtaaacagcagcatttcatttttcaagtggaatttggctgaggcaacggcacattgcacctcctttaccaaacgacattcgcttctcccacacctcacctcacccaacccctcgctgaccacttggaatttagggtgattcacctgggccccaaagccatcacccccccacagagggcagcaaagggacaagcggcagggaggatcctttgttcata

SEQ ID NO: 633 - DNA, 500 bp, Homo sapiens
ctccccccaccccgggatactgcgtccctccgcgtggacgagggagaacgcattcacagtgttcacagcactttgccggctgtcacaggtacagactacctggatatttagatacgagagcatctaacagggaaccatcaatcttttatggtaagagaatacataaattataaacaaatatgtcctttggtctcgtagaacagcataatgatcaaagagacacaatagaaatgcatttgcttctgcagtcggtgtattcccccagctcgtgggctgtgctgacggacagcccgggagctggcagcttttgttccatctgtcagagtatacttacctcctgttgttttaagtaatcaatatgggggctgaaatcacctactgctacctccgctacctcctattttgtccactcataaattatggattgccgcacaacatcaagtctacaatttcgattgcatttgctaatcattgatcaataattcaggagcctctcctcc

SEQ ID NO: 634 - DNA, 500 bp, Homo sapiens
gagggttgcttgagcccaggagttcgaggctgcagtgagctgtgatcataccactgcactttaacctggaagaaagagtgagaccctgtctcaaaaacaaacaacaatcctcccatatttgtaatggacatgttaatatggcaatactaaagtaatttttatagtggtaaaagtgtttactgaacctacttagttaagacaaatcgtaatcaaataatgctgcagccagtcagtgcttactgagtaagccgaggtttaaataaatagattgttgataaactacattatcaagattccttggttacagacagtgggaagcaactgtacaaatttaaggagaaaaaaaagaggaacatttggaaggaagtgaggtagatgacaaaattgaaggacaagctggaaaactaggacacaacccgtgcagcctagagaatccaggtagcaggcactgatggcaggttttgtagggcacagtcagtgcggtgaatccactccaggtg

SEQ ID NO: 635 - DNA, 500 bp, Homo sapiens
atggaccgtgtgcagcagccttttcgcctgttctctttcctgaggttgagtgtgtttttaagaattcgtatttctactagaattcctgcgatgaggatgagtgtttcgtagcatttggcctgtatcttaagcataaaattcttgagtaaataatttcagattccagttctatttgtcatcagagtgatttatttgagtaaatgcttggcgtcggcacagctggcttcaagttaatttcagatgctaagccgacaaacacaggctcctgcatcaagaaaaaagagaaaaaacctaaagcagcttcaggtcaaggaagcacaagccaggtgcagtggtgctcacctgtggtcccagctaccctggaggttgaggcgggaggatctttctgaaaataggaatccagttttgtcacagtagagcttgtgtatattcagtattggagacaaaccttggctggctggctttgaccggcgggaccgtcttggtggttaaaatcagga

SEQ ID NO: 636 - DNA, 500 bp, Homo sapiens
gttgcagacaacctgttgcccactcctcgactcctctgagagtcacctgtgcaagagagagggcttcctcctggtagagactaataaagcttttaatatttaaaagttcgggcacttaattctggtgatctgggttcacgggtaacactccgtcctctgacagctggcagatggcagagtccactgaggcgctggtgatgatgatgggaactttggccttgaggctggtcagggaccagggcaggtgcacggtggtgaccagctcgtagcgagtgtgcatgatctcaccgtcctgcgtgctgctgctcacggacagcagcaacggcaggttgaaggtgctgacaaccttggtggtgttgaagcgggtcacgggggtgttggcctcctgcctcagaagctcgctgctgtccagccgagaccgccgctctgcactgggcgtgaagccctcgtactgtatgtgggcatacagggcgaatacgaccgtcttgatgcatttgctg

SEQ ID NO: 637 - DNA, 500 bp, Homo sapiens
aaggaccccccaggagagagaagaccccagcagagtcaacactggaggtcctgcggggtgggtggtgctggggaggccacacggggagggctgttccctgttcccttcccctcaggagacagctggcccgaggtgacacagcactggatgcgatttcagggccagggaccatggtgcccggggctgtggaccacgccagcccacagccactgcaagccccagaccggggctgtggataacgccagcccacggcagccacacgccccagaccaacacgagaagaacgcaggccgacaacatcttcatctatggtaggtgacccggttatcgttcctaagagagtccacggccacttctactgggttccctatactcttcccctgccccagctggtccccccatgacagccgtgtccctgagaatgggatgcagagccaggagggacgtgggccccttcagtttgcaggggctgccaggcagcaccttccacctgccgaggg

SEQ ID NO: 638 - DNA, 500 bp, Homo sapiens
gtctctgccagccatgactcaggtagtgccacacagcagtgaagcatttgatcttttctactggctctttcatttgcagaaggggcagggaacacacaaaatgaaaagcgtgtcttggagcaagaggccgtgacaagggaatgaaaccaagaagcccgcaggtcacacagcaggcaggcggctgcttcccgtgggtgtgcagagctgatgtgcagagacgtattgatcctccgtgctctgtctcaccggcgaggcagtcacggtctgcatattaacacacagcctcagctgcctccagtggacggcaacattttggtcccagaacactgagagcaagggtagtatctggttaagataaaggaaactgcatcggcctcgattgtacccagcaagaattgaggtaaagtttctgaaacttaattccatggaatcccgagagaccaattgaaaccaaaatctgtaaacagactggttgccaccagttaaagtgattgtctcca

SEQ ID NO: 639 - DNA, 500 bp, Homo sapiens
atggttcctgagtaagcttgttcatgaaacaggtttccagttgagccatgtgaacagagacccgccgcacacctttaaatggtatacactccaagtccagaagaataagcatgtagctttgcttatgtttatggagctggagcccagggatgctccgattggcaggagtcggggaaagatcagccaatcaaagggcgcctccatttcagggaaactcctgctcatttatttagcatcttcagagatcatcggcttttccaggaagagcttttctcttagagtatcacaagagaaaaataataacttcgtttctattttagtgtcctatgctcttttgtcaataaacccatagctccccgtcttggtacttctcaatatatcccccactttttcttataaagaactaaaaaacaaataaggacaagaagaaaaagaaaaagctggtgatgggctggagatagttcatattcatcagcctccaccttgttgggagaagtggg

SEQ ID NO: 640 - DNA, 500 bp, Homo sapiens
agctcctcctgaaggtactgtatgaggtacctatgcactttccaaacgctaagtgaatacgcacttggagaacacttgcttgataattttgtggcattgccagataacgcggacaaagtgagaactacgcaggtgtatggatgctgccttgcccagacctcactcacccagacactcctggatgttcaaggtgaccagccctattggcgcacaggcaggcacaggctgcacccccacagctgggccccgcgagctgaacgctaatcatgaagcagctgtgtttgctcctaaatctgtttatgccagtgtacttgttacacattacttaaaccaataaaatatgactccaaagagagagtaattgattggataaaaactaagatggatgcctttcaaagacttgatatgggggaatttttttttctttttcatctttttaaaattgttatcaaattaggtatgggcagaaaatatatacaatgtttgaggaaataattttt

SEQ ID NO: 641 - DNA, 500 bp, Homo sapiens
atattgtttggagtggcaatgtgcccagctgaaacactgggcacttcaaactgccttgcagctggaggtgggtctctctcattaatgtccaatgagatgtgagcaaactgtactaattggaatctccaagaaagcatttaaaaagaagacagacttggcagcattacttggcccttcacccttcccattcctgcttagaggggcaatagccattttgcaaacacgaggaagaaattcacaagccaaggacggcagaaagaacccaagaatccatggcatcagagacctgcttcttactggaaaaaaataaatgcctgactttgtaaggccactgtagttggctttctgttagatggagccaaatgcaatcccaactgatagaatgcgccatatagaaaatgcactctggcatgcacccacgtaggtggatacatgcaatcctgagccttagagatagattaacttaattttctctttgaggttaaatgagcactgttcat

SEQ ID NO: 642 - DNA, 500 bp, Homo sapiens
tacctgatatccaaaacaaaaaattcagatcacaccctgaatgtcctccttccctttttaggaatgtcctgcagctagcccagcaccacagctctgggctgaagcatgccaatgttggcactgcctaagccaaacaaacaagatgtttaacagtcaaataaaatgtcctgcagcctccctaatgaatttgtcaaggaccatcagatttcgcaccccctcctttgcctcattaactcaagtatgatgagacggattataacaagagaatacagatgaatcggtctgaagacttgaagtggcttttagcctctagagtttctttctctcacttggtctcctttaatagaatatagtatctcctgcagaaggagctgccagttcgttttaatacaccatcaaggagctgctgatggacttctatactaacatacataaaagcagaggtgacaggggctcttcaattacagcctcctcggataccgtttcccccttcaattatt

SEQ ID NO: 643 - DNA, 500 bp, Homo sapiens
cctgcgtcacttctctccagctcacctccactgcgagagtgcctggggatgcctgccagccacccagagccagcgtcttcccaagcagctgttttacaggaaacaaagcaggatgaccttgggcttcctagtctctgcacgttaccccgaattccagaataatcgtgagaaggagccagtggagtggtgtgacttttgtatttatagacttcttccaaaggtcacctcttttatttctgaaaaacaagtcgcttgaggcccatctttacagagtgacaggagctcaggatgcagaggcaccaaggccagggaggagcgttgggggtggctggagctggtgggccaagggccgcagaccacttttgccctgcatggcctcgtggctgccttttctacctgcgtgagctggctttgatctaccccggacccatctttctgtgaagagtttgcagaggatgctggttacatcttagatggaaattggccgtgtctctgctgtt

SEQ ID NO: 644 - DNA, 500 bp, Homo sapiens
agaaaccgaggcctggaacggaaggtaacttgcccaaggtgagaaggcagaagagagcttgcattcaacggaggggcacaccattgcaattccttgttatttttccagcagctgcctgtgtgcttcacgtctctgtgctgatctgcccgagaggtgatggtgtccattggtgtgctctggggctctgggagagtgagatgagggctggggagagggcaggtagaggaagacttgtgggaacacagcaagcgctaaataaacagaagccgcctttgtgggatattgacattgtcattgttccagctgggaaaacttcacctgaaccaggacccaatttttctgcctctcttctccagctcctttctttccctgttgtccagatacacctcctccagggagcttccatgaccccccagcagaactcaccatttgcatgttgttacggtcacctgcagaggcagatggatcccatccaaggtttggtttgaatgaagactgac

SEQ ID NO: 645 - DNA, 500 bp, Homo sapiens
gttatgaatggtctcatgctttctgagttagagctacagcaaaagtagtaatgtgcacaaaaccagtccccacctgagttccttctccagcctcaggattctttgaagggaagaagcagttcctagaactccttgaaattacactcaaaatagtgtgtgcatgatatggatttttttgacaagagcgtcgatgctttccattgggttcttaaaaaggatctatgactttaaaatggttaataacgagtgcgttgggcattattttgtctgactatctctcttgacagataaggaaatggagttctttgaactctattttctactttgagttacagtgtttattctgcaggaacagcagcacagcctgcgcagtatctgctccttccttagtgctgcggaaacttcctagtgaggccaaacagcagggtaagtggccagcacttcatttttcacaggaaaatggagagtccccaaggaagggaggcctggctccttgccca

SEQ ID NO: 646 - DNA, 500 bp, Homo sapiens
aacctgggagacataaatgtctttgcatgctgacttatctaccagtcacgaaaccagtctggtttaaaattgctgttattcatttcagctccacaacctttattttcatgacagtgagttgaaatagcactcttacctctgttaagaaaaacaagaaatgacttctatctaacaaatgttaattagggcacacgatgtggtggaaagagtcatgaagtgagatgaaacctgtgcactgatatgtggcatcgggtgggtaattataaacatacacttgaaaaaaaaatgaatgacatggagtcccgggtccagaattaaccagttttgtggccctgggggaagacactctcctctctaagttcattttccttggactcagtgatttcctaagattccttctcacttcgcagtctcaaatttaaaatcagatcttaattatgtactaagtaaatatagcatacttaatttgaaggatggcatactgataaagatagttaaga

SEQ ID NO: 647 - DNA, 500 bp, Homo sapiens
gcacttatggggtgctctaacttctcagcgctggccgtcaccaacgcaggccggcagcaccctggaaaggcccaggtcccgcagctctccctccacgcgtggctacggtggaggaacgaagagcagctgtgagttcgtgggaaagaagggctatctggaataatacgagtccgggtgacatatgtaattgtgagtttttgttttctccgaactggccttattattattaattattccttcagcacctaccgggaaagcgagaagaaagcaaagggcatcactccctacccacgaaagactcacaacatccctggaaaagcaacgaggcgaacggctggtctgcgttcagagctggtgaggagcagggagaagaatccagagcgtccccgcctccctccctcaccgccctcccgcactgatgtgaacacgggagtaacaccgcgcgtggggaatccactggcacccagagcccggcccgcggcagcagaatcacccaagac

SEQ ID NO: 648 - DNA, 500 bp, Homo sapiens
ccagctgtaccttcacccagtctgggggactggtgaggcacttgggggatggggagcaaggccagctcacgaaggaagacttgggcagggaggatcagggacgcctggcaaggatccaccctatggaatcgggcctcgtcagtggggtgacaatgtcagagttgtctataaatcgggggggaggccgcggcctcgaggtgggaaagcaggtgccggcgcacctgtggacaaattctggaacgcgtttggcgagggaggaataggcgcagctccggaaggcagtgacctcgaggcagcctcagcacggcactctcttgggtcctcttccaggctcacactgggcgacagcggagaggctcttggacggggcagagctcgcgccgagacctgcatgtccgcgtcttgtgacgggtgtgtgggaagccgcccgcctgtgcatcttgcttccgggtattcgctggctgatttactggttttagagatggggatgggcacccagt

SEQ ID NO: 649 - DNA, 500 bp, Homo sapiens
gaaggagcttttgtctgacagtcctggaaccagacattgattgctcttttctttttccttgggagcaaaatcaaacaaaccccctacttcagctgttgatctcattccaaactcatgcctaatctctgtcgggcgtttacaggaaagccttctaacgcctctgttatcagcgcatgacggcagacgaggagccgccatgctggtgtcacttggtgtggtgcgctggctcccgctccctcgttacaaatccggaaacattttcccatgtgtaaagctcaggacacatgagcctgagcttaatttagtagcttatggccaactcatgatggaaggtctcagactgtacggaattaaataatacccgaagatgtcatagtccgaggcaggagctgaagaggcgttggccgcggccagttggctttcaccgcagcccggtgtagcccgccagcctcgtgcggagtcctggtcgaccccttgctgacagtgtgatcttcatttga

SEQ ID NO: 650 - DNA, 500 bp, Homo sapiens
cagagggcagcttggaggagcacgcccgagtggacaggtggggagctggaaggcttagcggggctccttggagagcagcgctgtccctgggcaccacggaggtggttcctggccagagctgattctgtcctgttcaattttgaactgaagtgcaaacaagcctcagcgcccgctgctcccaccccaaatcgaattcgtgctaatatttctctgggggcggcgggctgcctgccttccggggacggagggcgggggagactggcagggaggccaggcccaaccacggggctgccgggaccaggccatgtgtctggggcggccggcttagctggctgggattgtccacccaaattaaattttaacccagctcataaatcttccactaagtacgtcccctgccgcccgcccgggtccaccccaggccgcagcgtgggccagcacagcgacagccttgttcctctgccccacatggctgtggggaggctgggcctacctgcctt

SEQ ID NO: 651 - DNA, 500 bp, Homo sapiens
tgctcccgcagctcccagaactcggagggctgcgggagttactgggggagggggtcgaggagagcctgggggcctgggggtcagaagtccaggagcgcgagcagccggcgtccgcgcggcggcccctgccttcgccttgtctctcttgttgtccatcttgcacctgaagagacaaaccggtccgcatcccaggttctggacagctacgccgcctccagagacctggaccctgctacctcactgccctttcgcagcatcgccacccatggacactcaaacctcggcctcggcttccatccgctcggctcccacgcacctacacccactcgccagccccactgctcctcgctgtccccaagtcccaccccccaccgcttttccctaaagcgaagaggccctgcccgccccagcccaccgcctcccccgcctcggctccaattcaggaccgatctccacgcccctgccccttgccccttcagggactcagaccgccagcctcg

SEQ ID NO: 652 - DNA, 500 bp, Homo sapiens
ccctgccgggccacagctcaggaaagcccggctccttgctccagaccctgatcaggctgcatccactcctgctcggcagcttcaggtttgtttttctcttgtcaggtttgtgtgttgttgttgttgttttgtttttgtctttttaaaaaatttagggagcggggccaccacggggaagggagaagggacgtggctcctggcgctacattcgggagggcgggctggccagttcgtagaagagcaggtaggcgtcgctggtgcgcacttggctggaggacatgggagtgacgctgcggagagagcggggagtcagcccggagcgggcaggaccgggagaccccccgccggcttctttctgtgcccccgaggccggccggcctgcctttcagggagcctccccacgggcagcggcttcgtggccttaaactttgccatccattctcggtgtaagccgtgcggggggtgggaggggggtgggtttggggggagggtggaggagt

SEQ ID NO: 653 - DNA, 500 bp, Homo sapiens
gacagaaagtaagtctctccgggcctctccacccagccaatgacagtatcacttcaggaagagacactccctgttccccaacttcggttccccctccgccaaaaccgtatgatattttagggaagcccctctttattcattagaaatcggctgctttgagtttggcccctaaaaacttgcctcctgccccggaagatttattttattaaatggtccacacctgaaagtaattgagtctcggcgtgggtgcggggactgcggagggagggtccaggcgcggcagcggcagtggcggcggctctcagctcctctccagcttcgcaccctgtgcctccgggcgccctagtctccccgccacgccgcgacctttcctcggcctcccgctcccgctttgcggaaaggtccggggcgcgtgtaggggaaggagagagaggtatgtggggcgagcgggagttgagcgtggatgtggggaagggggtgcgtcctgcgtcgcccccgca

SEQ ID NO: 654 - DNA, 500 bp, Homo sapiens
gttctaatgaaagccatgcacgaatactctcccaaggagaaacatatgtacaacaagattttgccttctgttctgggggaaaggggggtgccgttagaccctcgaagtccatctgtgaagcgcctaggtttaaaggggtccgggtttcctccactgccacagcccgggtgcggggagagggcccctagccttatccggagatacaggatgtctcgggctctccatctgccgggctctaaaatgggcgctcggtccctgggggctgcatccggaggctggggggactggtcgagggagagcgggcggggggcagcgcggctcccggttggtctccgcagccgggggagggcgagcatgtgcgctcgggtaggagggggaggccggcgcctggcaccgcacggggaaggcgcgggagcggacgcactgcccacccgccgcagaggcgcccccgccgccgcccgggcccaagggcggggcccctcgctggggcggcccctccc

SEQ ID NO: 655 - DNA, 500 bp, Homo sapiens
agcctcttttaggtctaggtgagggaggcctggtccattttcctgcctatggaataaagaagtaactggctagccttcctcagagtcccagcccaaaaagtaaataaagggttaaacccactggcccgccttcgcccagcctccggctccaccccacatctgctagtaaaagatgctgggcctccaaatacgggaggctctgtgcagtgcgactagcatttggggccagctacgctacttctccgacctcggcgttcagccaccccgtccagttgccctgaacaaaatgtgagagtcatcccttttccttgctaactggattcctaagatcataaatggactgcatctttggccgggcgcggtggctcactcccataatcccaacactttgggagtcggaggcgggagcatcggttgagcctaggagttcgagactagcccaagcaacatagtgaaaccccatcgctacaaaaaataaaataaacaaaattagctgggcg

SEQ ID NO: 656 - DNA, 500 bp, Homo sapiens; identical to SEQ ID NO: 35

SEQ ID NO: 657 - DNA, 500 bp, Homo sapiens
agggagaaagaagcaggagtgggagtgggggagcatgttgggggaaggcagtgagggtgtcctgtctgcagcagggcatggaggggccccagcgctgcacttgcttcctttaagcctggcctgcttgctgtcagccccgggggtggtttcctctctaggaaaagctaatgtcatgcttatgctgaaaaactcttttcagaggtactttaggaggggcctggctctcgattaatctgggccatttcataccggctgtgctcacccaggcacaaacactgaaagcaacagctggcaaagccatcgcttggtagcagcttggaagacaccaccaaagaagctctcatggaagcggcagatttcctgaagcgactggaatgcggggaaggagggcagtcggggagagccgagaaccagcccccctgccaactccaccccattcctctcctcacctgaaatgtctcatccttagaacagctgccctaaccccctaatcccacaca

SEQ ID NO: 658 - DNA, 500 bp, Homo sapiens
aatagcatagttccatacaaataatgttaaaggaaaacatgcatatatgcagagataacattctttttgctttatgtatcttctataatgttaacatttttgttatgaggcaggaatcatgttaaatgaaaaaaggaaaaacagcctaggtcttgaggattaaaaaggactgaaggagaacaagagggagtagagcacagcaggcctgtttcccttttaggtcccctcccccaatgcagagggacttcccgccaaagctcttccggttttcagtctggtccgcagaggttacccataaaagaaagctgccatcacaggcagcagacctttgttctctgaccacttgataatgtcaggacgcggcaaaggaggtaagggcctggggaaagggggtgccaagcgccaccgcaaggtgctgcgcgacaacatccagggtatcaccaagccagccattcggcgccttgctcgccgcggcggcgtgaagcgcatttctggcctca

SEQ ID NO: 659 - DNA, 500 bp, Homo sapiens
cacctccaggccgttctgccagcccaagctgctgctcacagaccagcatcgctccccacctctccccgcccctgccgtggttgaggccgcctcgcctcggcaggaagcgcccagcctgatttcctacaagtgtttgtcagaaggagggggtttgtctgcgtgcagagcaagagctggaggagcttaaccccttgcaagccctccgcagtcagcgctgcccaggaaaggactcagggaacaaactcctgacgtcctgggcttgggatcatctcagcccaggccctgcaggtacagatggggagactaaagcacagagaaggtcagaggcttggccaaggtcacacagcatgctgtagctcctaccctctaggccctcttcaaccacggcctgaccttagccgaggctccttccctcactaggcctcagggcccatgtgcacggtgagagctcagactcaacaccactcctgcccttccagctctgactctgccaatgtgca

SEQ ID NO: 660 - DNA, 500 bp, Homo sapiens; identical to SEQ ID NO: 32

SEQ ID NO: 661 - DNA, 500 bp, Homo sapiens
tttggggcgtcgaggcctccccacccgttgctaccagcccttttgcagcacttcctgggcaggccaggggagaggacggaaaagtgaaaaaagaacgtgtgcgcccagcggacccgacttaacctgttggtggaggaggaagctggcgtcgggctgaagtcccccgagccacccctggagccagagcagcccccgagcattcagagaaagccgcccgtccccagtcccctcggaagccggtcataaacccgacttctcatcacccgaattacttaaatgagctttgatggtgttaggtccttttccacgtgcggatgactcagcccgctgcagctgcgcccggggaggtgaccctggggcagcggctgaccctgctgcgccctgtaccctggacccagacgcggcccatcccagcagcaccccccgccccaagctcccagaccacacttagctttttttttccccccttactcttcgagtctttttcctcttctctaaaa

SEQ ID NO: 662 - DNA, 500 bp, Homo sapiens
ggcggaagcggagggtggctgtccagccgggagcctctgatccacggggcttggaccagccaccccacccgagggcggctgaggactgggcggccgagctcgcggcccacttagctaatgccgggtaatgccgaccccggcccaagagcagcagctgcacttgggaaggaaaactctttaaacaaatcattttggtgtctaatcaattagtgtttgcgcagtcaagtaccgtagatttaacagaataatcgttactgcccttgtctttatttgacccgcagacacctagaagatttaaaaatgaaacgccggtgttccgggctccccacccgttgccttcgactccctccggggcctgctaggccaggtcggggcttttgctttctccaggcctaatctcctctttgcctccctcttcaaccctccttccccttcacacttttccacactttaccttgttttcttgcccttccagccctgtcggccttccgagtctcgat

SEQ ID NO: 663 - DNA, 500 bp, Homo sapiens; identical to SEQ ID NO: 44

SEQ ID NO: 664 - DNA, 500 bp, Homo sapiens
taccctttcaacgctgcgccttctcagagatccataaggaattttcagtaaaagtctttgggatctattcggagccactgcagcctgaaccaccatggtgtacagctgtgtgtgtgtgtgtgtgtgtgtgtgtgtgtgtgtgtgtgtgtgtgtgttcccagcaaagggagagaaggagcctccctcaaaaataagttatggtctcctggagggttcccaaatatcaaataactgaaagagtttttctttcgaccatctgagtcaagatgtggtttgtcaggaggaggggggatgggaagaaagaaaaccagcccaagttctgcaacttcagcgcccacgaagcagcatctctagctttcttccatctgtccctctgcacagctggctcagcgagactgccgtgtcccgcttgtgggcaagtgacgcgtctggggagagtgatccagaaatgtcaactttgcttctcgtggctgcagatggtaatcaggtcagttgtctaa

SEQ ID NO: 665 - DNA, 500 bp, Homo sapiens; identical to SEQ ID NO: 41

SEQ ID NO: 666 - DNA, 500 bp, Homo sapiens
ttctcagtacaaaagttggcaaaacagctctcttttttaaactgaactttgtaataggagaaatactctcacaaggacaggatgtttctgagccaagttgaagcaaaagaaactttttccagcatgtcaggaacgaagctgacgttccattaagaaaaaaaaaaaaaaaaaaagaagtgctagaggaaggagtaagaggtgaaaaggcaccagaattcagacggagctttaaattccagacagggccagcgttgggagcacgtaggaggcgcccctcggaaaggagccggagacccagctgacttcgcacttgagctccagccccgtggacatttcctgttctgcctctggaaattcaagctgaaagttacaaaacatccttttccctggaaccaagtgcttggttgggagaccatgccctccccttccttcctcggaactcctccctgatcgccccgtggcttccccaggagagatgcgaaatcagcggtagcaggtgg

SEQ ID NO: 667 - DNA, 500 bp, Homo sapiens; identical to SEQ ID NO: 48

SEQ ID NO: 668 - DNA, 500 bp, Homo sapiens
cctgtcccgccttccattccccactacttggcagcccaccgcgtccacccgcggagctgcggaagccagggccgggcaaaggacactctacgaggcacagcctccggcagggccacacttacaatgtagacaggaaaatagaggatttaaattcaaaaagtaatacgagctcgatttttttaaaaaccggaagcaaagaaggatcccaggaacagccactgttttcaattctgggcgagtccttccaggcgatttttccacgctcttatagacgaacaaataaataaaagcagaactatatttcataggctgttttgcaatttaccatttcaaaaaaatttaatctgcagtgatcatcttctctgctgaaccagttcttgctgtcccttgactgtagaattaagtattcctttagttggggaaagcctaattcccctaaagactggagggaccttggggttgtttttccttaatataaacactgtgaagtaagctccgaa

SEQ ID NO: 669 - DNA, 500 bp, Homo sapiens; identical to SEQ ID NO: 42

SEQ ID NO: 670 - DNA, 500 bp, Homo sapiens
cactccagcgtgggcaacaagagcgaaactctgtctcagaaaaataaaataaaataaaatacgttcttttttataacactgactgttggacttcaaatttttcacttagaaatagagacccaaggttattttcttaataaatatcaagtggagaaagagtcctgtggatgataggctacttgaagaggcagatcctaggagcctctactctgccaagctttggccttggtaaaggagctgcagtgcctccgctttgccacagggtggcaacagttgcttcccatttgaggatggcggggtgaagcaaaccttgaactgtaggggacactccgtttctggctagtctctctctgcagttggagaaagcagtgcagctgactcttatgtgtcttgactaaaatctgtttctaggttatcctcaccctggaggaaccaatgagaacattgggcttgtaggccatctatgaatggactgggaccgcccaatgggcccatgcctt

SEQ ID NO: 671 - DNA, 500 bp, Homo sapiens; identical to SEQ ID NO: 196

SEQ ID NO: 672 - DNA, 500 bp, Homo sapiens
tcccgcttctgccagctccagcctcagttcccgcccgccctccaggcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggtgagggccggggtggggtatgggggccaatggagggcctcagggcagcagcagaggcggtgccagggggctgtagcgctggcaagttctcatccggggtcgcccggtcccccgaaggcgcgagagcgagcacgagagggaggtgcgcgctctgtacgaggagacggagcagcttcgggagcagagccggcgcccgccgagtcaggtgggcctcgggccccgcccctcccgccaggcccaatcccacctcgctggcctccctggctccgccttctctgaattaatccctccccgacggccccacctcc

SEQ ID NO: 673 - DNA, 500 bp, Homo sapiens
gaagagggaggactgggctcagcgcctgagacaggagggccgtccccttctctcttctcacggccctgtcccccacccccatgcccacggtcagtgtctcctgcacatacactcacctcctctcatcgtctcatctcagttctgccttagtgtccccccccccgtgtttccccactttcctcacatcccccagggaaccctcccctctccccggcagtgtcccctcctcctccctcttcccctctcctccgaaaaggtggccatgtaaacaggaagtggctcaaagacatagagggagtgtggctggaagcctttacacatgggaggtaatttccctatcatcacccaaagtcagatttcatgtgtgttctagccagctctgtgtgagactctgggcccagtttctggaactctccatcaactgtcgtaggcagagcaggaagccaagtcagcagctgtgtgcttcagttcgctggtgtctgtgtggctgagggccgtgt

SEQ ID NO: 674 - DNA, 500 bp, Homo sapiens
aggtagatgcggtgctaggatcggggaagcaggcagagtgaggtaataaactagggtgctctttggcgtttcttgctgctctcgtgattgttctgtgtttgtgcaaggccgactcgagatgttgactcagagcttcctccccacagagcgcgctctcgcacgccaggcagtggtacgagccgccgccgccgccgccgccgccaccgccgccgccgccgccactgccaccgccgccgccgccggtggggacgtgaagcaccatctcttgcaggttcaccacagactggccgaagaagcagagggacttcaggtggctcctcgctgcctcctcgtcgctgaagcccgcctggcacttgcggcagaccaacttgtactgcacctttggaacaatgaaggggtcgtagagggagtccgcacttttgctttctgcttctggctcttcagggagtttcggcaggaggggggacacctcacggggggtgtttttctgttcttctggt

SEQ ID NO: 675 - DNA, 500 bp, Homo sapiens
acacacgcgcgcccacgctccgcgctctcccttggccgagacaactgggcgaacgcggccgccagcacgcaatgcgcgtcctcctcgcccccaggtgaggactcggcaggggcagggatcaggctacccagcgcggcaggaaggcgcgagaagccgcagcgacttcggggtacagtccgggcgctgtccggtgaagcgcggcgtgcacgtgcatgccggtgtttgcacgagggagcgggtgtgtgagtgcggctctcccaagtgtggcatggtattgcgcgccgcgtgggttaatatggggaggggtcccccgctggtccaggactctgctgggacgcgcagggaatctcggcgccgctcgcgtgcccgcgggccctcgcgctgggcgtgcacagcctgctctactcccgcagtcgagccgctctcaggccatcctttctttgaccccagagccaggacttctcactgccgtagctgcccgccaagtgctccacctcggc

SEQ ID NO: 676 - DNA, 500 bp, Homo sapiens
ggcgctcggggggccaggggtcccccaggaagcgctgcccgggagcggctccctcatgaccgcggcagcagccccagcattgggtcggccggggcggacgggggcggctctccgcccggctgcatttgcatgtcggtttagtcaccgccgccggcgcctacttcctctaaggccggggctgactttcaggaaatgatgccggccccgtaagtcagggcaattaccggcagtgcgaggagaattactgtacggggcggatctcccacaggcgctgtcaacacgcaaccccacccgtgccccgccgcaggaccagccccctttggggcacccggcggacgtgcagaatgcccaggtgggcatgggcctcggtctccccagactgcagggagctgggttccgttccacggggaccagctgctgttcctggtgcccccaaaccacaggcagggaaactgcggccaagaccgcctcccttcacccagcaccccacgcatgccaag

SEQ ID NO: 677 - DNA, 500 bp, Homo sapiens
gggcccaggtcgggctctgcactgtggcctcctgcccatctggccaaggctttcgggatccccaaaatgcaaacgggtggctggtgcctgagcaggagagggaaggctttatatgaagagaaatcgttctaaacacggtaggaaaactggaaaaggcgctcaccctcctcccccgtcccccgtgcctccgtgggttctttaccaggcccggggtttaattgggccttggcataaggctcccagcaagcgcgggacattctaggctagctgttcccgggctagaggagagtgagcgctcaggtctgggcccaattctcctgtaattcggcacaggcgccgcccccacttacccactggccccaaatatcgacccactctcggttttcccctagtcaagggccactgagagggaggaggagaaacagagggggtgggggagcgaaaggttaaatcctgaccctggaggaccgcgggaaagttcagagcccgagggtcaatct

SEQ ID NO: 678 - DNA, 500 bp, Homo sapiens
aaaaaaaaaattcctcaatttggaaacatttgcaaaactccagaagaaaaacttttaaaagttctccactcccttccaaacgtacaaacatgcacacacacaattaggaatttcccaaagttttcatctgtctaaaaagaaagtgccagtgcaaattacagaacatcgtcgcttcctcatgtgcggcgtttctacgggcctgggaggggacgcagaggctaccccggtggtcccagcctgcagcgttcacgtgaggaaacttccgcaaaagccctgatgcatgcacattctgactgcagaggccagagcatcccgcattttggaggctgaaaggctcccctaggataaccttttccgttaacagaggagtccgctgaagcgcagagctaactgaaaacagctagaattaaaatccaagtcacccggccggcatcagcagtcattcctttccaccacacaaaactggccaggaagacggactctggcgcgccctcccaggc

SEQ ID NO: 679 - DNA, 500 bp, Homo sapiens
ctgtccacacacactgtttttggggggagtgaggtctcgtttcatttcctgtatcctttgtaacaagggttgttggctttagcagcagcattcaaacagttaagactgtcttaaggaaacaagcagcctcagccctccctccttccctttctcagccagtctctggcttcctcttacgatttcactaatggcagctcaaagctgctgagctctgccctgacggcatgcgcccccgcttctgtgagagcacgcttcctggcatgggggtcgaatcatgtcgataaaatgggctcggtttcatgaagtaccccacataacagtgagattcataggaccaaagcatggggaggtaagagcctgacttctttaaagcactaaattctagtaaacacagaaagagccagtggagttggttgttttgttttgtttccatcctgggaagaactaatttggattgttgcaaagggaagctatttcttatttattcaggtttgaagagc

SEQ ID NO: 680 - DNA, 500 bp, Homo sapiens; identical to SEQ ID NO: 45

SEQ ID NO: 681 - DNA, 500 bp, Homo sapiens
gtgacgctgcggagagagcggggagtcagcccggagcgggcaggaccgggagaccccccgccggcttctttctgtgcccccgaggccggccggcctgcctttcagggagcctccccacgggcagcggcttcgtggccttaaactttgccatccattctcggtgtaagccgtgcggggggtgggaggggggtgggtttggggggagggtggaggagtggggggagagtgggtggctacagccaggggctccggccctgccctggctctcacctggagtcgttgaaagtgtgccattctcctgtccctggactgcgacagtaggctgtatagtggccacccatggtggttccggagtgattggacacagcgtacaggttgtaaacagcatggtctgaggaggaggcagccgtcaagcccccgaggcccccctgccccgacttcccccctccaacctctccttctgggtctctcagtagctggtgctggcagctccccttcct

SEQ ID NO: 682 - DNA, 500 bp, Homo sapiens
aacagagctggagggcggcacccacactctccggtttgctgctcgcctggcccggccccgcacagttcccttttctgaatggaggggccatgtgaccacctgtttgctcagccgtggatgctgcttctgcacaggggccgtttgctctagaaagttcacaggaagcaggctgctgggctcagggagtgcagagtggtgggaggaagctgttcaagctgcccaaagctttccggttcttggcacaccccccgtcccccgcgcccccagcaggatggaggattcccagcctggggtcctagtcaggcctcaggtagccgactgtctgggccatcctctccagcctgacatccttgtctccccggcagctgtggagggtgcccctgtgcccacctggccagcaccacctgcccagctcagagaaggggctgtggctgccgcctgccacgtagggcagattgcttgcctggaagggctgttcttgacttcctccttccaaggag

SEQ ID NO: 683 - DNA, 500 bp, Homo sapiens
ccactgctggagagaccgcggactgggtgacaagtcttccaggctcccagaaagtttctgctgcaaagcgcagggtccgcctcccacttccaggagggaccaggagggaaccatcgcgaaaccccgaggctgccggggactctgactgaggcctttcctcctgtgtccctctcccccacgccggcctcccctcctttcaactctctgcgctttgaaaccgcggagttggggtagctaggccctccagcccggcgacaggcctcggccacaggcagcggggcggggtgtggacaggaacaaggaggtggggtggggaggaagcctcgggcagagcaggttctctgcggagtttcggcagccgggtttatccattttgattaaagaaaagtaaaaaaaatcccccaaaaccaaacaacaaaaaccctctcccaacccccaacccgcctccacagctgcattttgttcctgggactgttggtgtcaccagagcctcttttttt

SEQ ID NO: 684 - DNA, 500 bp, Homo sapiens
agtggtgcttacaagcatatccaagacaaatatttagacagcaacgggaggctgtctggacatcagggtactctcgttcctgaaagcacagagtgtctcagttaggcaacaagagcgcctgatgggcaagctggtactgcctggcagcagctagtctggcagtcgctgacaacacaggaaggcttactcagcccacaggaagcaatcctcggcctctcaccccacaggctgagtgagcacagtgacatccggctgagctctgttctggccaagagcatgtcacatccccaacaagagaggtaattcctgagcacactgggattggcctggagggcaccctcattaatcctttaaagaagttaaaaacttttcatcctgtgttgacttaagtagtaacttaaatatttctggtccatcttttcgaaatatagaaagatattcaagctaaaaaagaaagctcaagagacaagattctcatagtcaagatcacagacactctg

SEQ ID NO: 685 - DNA, 500 bp, Homo sapiens
gtttcatcgctgcagggaaattccagagggcagctcctgccacaactgcggtgagacataatttccttgggaggaaaccagttctcagcagccagaaatgaaacagtttccactctgggagggcgcaggagggtgtggctgcaggcggggcagagctacccgcctggagagcctgctggccggcctggctccctgaagcctccagtcacagtttaaatttagaccttctattctggtccgtgctgctcacgcctcaccccgtggccaccggtcagccagtttccccgagcacaagtgtgctccggagggacagaacacgtaggaggtaaacggtgtcctgaccttcgttctgtggtggtgtggaattgtgaagtggaatggaagaaagaccaaggccagaaaaatcctccaccctaacaaatttcagaaccagggaccccatgtgcacgcgccccactaacttcacagacagaaacatgcttgtcctacagccgtttgtg

SEQ ID NO: 686 - DNA, 500 bp, Homo sapiens
tcttccgctcgattgttttcctctttttttctgtcctcctgcggcctcttgtctagttcctacccctacttcagcgcaggcggcttggaaagccccggccagaggctagtaactctcgcaagtgggagatgctctggcgacggatctctcttttctgatccctcctcccccttacccagcgcggatcacacacatcctttgcctttgattagcatcttaaagttgcttagcgtgccgcttaagtcccagcgtctcagctggcggtggtttggagaggcttaaaactgcattcatgaagtttggaggaaagaaatcagacactggaattcagggctaggagcccagctcagttttaggtcagaaggccgagtctcagtgcgagattgaggaagggtcggggcttaacgggggaggtgggggtggcgggggggggaacagcacggcgcggcgcctagcctgcgagatggagtcggagtgggggtgcgagcggtcctccaccg

SEQ ID NO: 687 - DNA, 500 bp, Homo sapiens
tcttcctttccggcggccagtcgtcctccctgaggccgctgctgggggctaaaggctatcagagactccagactttatttttgcttcaacagacttctcccaccatgctgacttagcgcggtctgagcaggacccaccgcgggtctcacgaggaaaggaggattataagcagacggcaggaatgtgtagggagctgcagtcataatttatgacaagccctgcaggaaggggtctgcagtacagtaaatgcgcaatttgtgacgctctcgagccaggagccggcgcaggctgggtccgcagacgcccggttcccaccgcggccggcccggtctttgtcccgggaagtcgcctgaccccgccggccaggaacagtggcgttctcggcgcgtctggctgataaggcctttgtgacaccggggacaggctgtaaaaacgcagccagcttttgtctgcacctccgcgccgctggcaagggcggggccggcgagtgtggaaaagtt

SEQ ID NO: 688 - DNA, 500 bp, Homo sapiens
gacttgttggtggatccatccctcatggcggagcagcaaggggatcctttagaaaaagcaatgggcgaagtaactgaaagagcgacgcagaaagcaacagccagaaacggcggggacgcgagcggcccagacaggaagggaggcggtggcgcagctctggtgcgcagcgcgccgcagcgacggaacttctgcaaaagctgcctgcccgcgcgttatcagcggcgcgcaggcctgtggttttctcgctctcgcaaccctgctttaactgccggtttatttttcgacaaacaggatgcctccatctgaggctgtcagcatcccaggctctttgaaagaaaagaagtagagcggccccaccctagaggcaaggacggggtctgtgtcaagaggcttcccagagaagtgaaaactctgcaggtgcagccgctgggagagcatcaagaagggcagggtggaggggcagggggcgaagggagggggtgaagcccgcaccctacccc

SEQ ID NO: 689 - DNA, 500 bp, Homo sapiens
ttaactactatatgaattacatgtgtaccaatgtctgctcagtatgcagagagcaactccaagaaaaggctatttttcttatcaaagtgagtaaaaaaaaaagaaaaaaaaagacacagaagaagacgagtttccttttgcaggcctctaatcatcaggaccagcacttcaggtttcggtggaaggtgggaagagaaggaaggaaaacaaactctggcaagagagagggagaaaggtttggaaagactacggaagtcttcgtatgtactagaagctttaagggcaaaatatgagtcaccaaaggcaagtgaaattgctgatctctcataaaacaccccttggctttctgccaccataacttccccttttaatcctatttctcatatgcagcatgtgaaaaaaggaccagctggctgcactggttttgttattttagcccttatgtatacacactttaaaaggctgaagaaaagcaactgtgggcagttacatcctttgta

SEQ ID NO: 690 - DNA, 500 bp, Homo sapiens
gaaggagtaagaggtgaaaaggcaccagaattcagacggagctttaaattccagacagggccagcgttgggagcacgtaggaggcgcccctcggaaaggagccggagacccagctgacttcgcacttgagctccagccccgtggacatttcctgttctgcctctggaaattcaagctgaaagttacaaaacatccttttccctggaaccaagtgcttggttgggagaccatgccctccccttccttcctcggaactcctccctgatcgccccgtggcttccccaggagagatgcgaaatcagcggtagcaggtggcgcagaagggagaggggagcgaccctggggaccgactctggggaccctcgccgaagaggtaggaaacgggggactgcacgttcctgaggccacttcacacttattgagcaaaacgaggtgctgtcctttaagcctggggctgaggtgtttccctcgcttgggtatgcgccgggtggtgggtggac

SEQ ID NO: 691 - DNA, 500 bp, Homo sapiens
ctacaaaatccacatccagctgacagaggcctcgggggaaattatagttcggaaaacggattagtcagagtacccagattttatggaaatgctgggaggttgctttgagggtgggtgtcgtgagaaggttcggggagaggtgggccagggttgccaatgggggcagggccgcggaaggagctgtttgtgtggggccttggcgacaaccgcggggcccagcggttcctgtgggtgctgacaggagcctggcggtgagtgatggaggaggcggttgtaaaataggttaccgtcgggcgcccggggttcactctgcggatggtgctgttgctaagctacctttagaattcgacaaggacggatgctccgagcggctccctggggtggggggaaccaggaagcagtgaattaactgaaaccgtggtgaagtcctttcttcctgaagagtgagagagcgtggtatgagagtgtgtgtttgcattcatatgtgcccacacaagcac

SEQ ID NO: 692 - DNA, 500 bp, Homo sapiens
gaggctatcaaatatgccttgccttctggaaggactaaaaaggtagcccagatgcagctgtcaagaaaaatgagatccctctaagaatacgatcatgatgttacagctttcctaaggccctgagtgaatttttaaaaatacaattcacattccataacgcatcctcctgagagcccagaggggacatgagcagcatgaatcactgtatcagcccctcctcctgacgagggcacaacacccagaatagctcggtgatgacgcagcagcctgaaacctttgaaagccctcatctttcagagggaggaaatgaaagcgaaaaacaagttcttgacgcagactttaattctcagatctttaccaggcagaacagagcagcaaggaaaccggcacggatcttttgattcttcccactagagcctgcagttgctaaatgtgtgtgtgtccatatgacaaatctgcctgattagctctgcttctgattactaacactactggggttc

SEQ ID NO: 693 - DNA, 500 bp, Homo sapiens
caggtgccccggcggccccgcctggcccgagggaagagggcagctgggaggggccccggccgccgcccgttcctgctgcgggtgagcaccaggtccccgcgggccttgcgcggtgccccccagctcagcgtggcgctcggcggcccaaggtctggggcgtggagggcgtcagcacctggccgactcgccggttcccataggctgcctcgccccgcgttttcctagcgggggatggcggctccccgtgtccgcatcgctgccgggccctgccaccccaaccccggccgcagtggctggaagccgtggccttttccgggctccgagagccggcggggcggttttcctccgggtttcctcccgccggggtcttgggagcccctcagcctcgccctccctgcagggagaaacctgtctactgcgtgaatttctaagcagctgatccttcaggcccaagactcctagagtggaaagggttccccggaatagtaagcgcgccgtca

SEQ ID NO: 694 - DNA, 500 bp, Homo sapiens
ctaaatccgaagcttccaccctcctctgcctctgtgacttgctgcgtgactttggagctttcggaaactcagtttccctgtcttaagccctctgctcctcttgctttcccgctccagcaagtgagagtggactgggttgccgtgccgggcgggtgtgggtcgccgggcaactccggagtctccccttccccatcggcccccagcagaagtcccagctcccggcgttttctgtctcgtggcgagttggggcggagggagcggcgggaaggtgccgggtgggcaaggtcggagctgcgtcaccgagaggccggcaaggccagggagaaaaggccccgctgtgatttggggaagggccgggggcccataagtcacgtgctcggggcggttgtgcaggagcggactgtcctctgggaacatagaagcgcccccgactagagtaggggcggggagggagcgccggaggaggcaggttctgggccaaggggatgggggtggggggg

SEQ ID NO: 695 - DNA, 500 bp, Homo sapiens
tgaaaaacagaagaaaatactcgggagacttagcatggggagagggcgtgaggattggtgagacagtttctttccctacttggctcagatatacacagtaaatgttaagtgctcatgtgaagcctctgagccctttcaagccactcagtgtggggagagaagagagtcacctaaagagcactggatgggagccaggggacctacgtgcagaagcttcctgtcccaaactgcaaacagaaagctctgaaccgcatgatctctaagaccacttcctgttgtaaaaatgctaaatttggagagcctgccccagagagttttaatcaacatgcaaaacaccgaaatgggggaagaatgaggcaaagagggccaggacaaagggctcttgctcaaaccctgaaggatgaggatgggtggggtagacagaaagtgagaggatggcacatcctttttctgggacctgctgtgtgcctggcactgggttaaggcctttcacatacatt

SEQ ID NO: 696 - DNA, 500 bp, Homo sapiens
gattgtggcaaaaggaggaatcctttcacttctcctattcagctgagcaatctcaggggctaaatgtctccacatttctaagcaacagaaaagaggctatcaaatatgccttgccttctggaaggactaaaaaggtagcccagatgcagctgtcaagaaaaatgagatccctctaagaatacgatcatgatgttacagctttcctaaggccctgagtgaatttttaaaaatacaattcacattccataacgcatcctcctgagagcccagaggggacatgagcagcatgaatcactgtatcagcccctcctcctgacgagggcacaacacccagaatagctcggtgatgacgcagcagcctgaaacctttgaaagccctcatctttcagagggaggaaatgaaagcgaaaaacaagttcttgacgcagactttaattctcagatctttaccaggcagaacagagcagcaaggaaaccggcacggatcttttgattcttcc

SEQ ID NO: 697 - DNA, 500 bp, Homo sapiens
aattccgcgagggctttttcacggcttcaagccaagagcgctgaagggaggaaaggtatactgatgccgtagggctgagggagggattccaggctcctggggtgttcttctgcagcaggacccctcgctggccgctgccagcccacttccggaggagttggcctcgtctagccaacagttcagtgggatttctttcttggacataacttcatatcattgaaatagtctacaaaagacaccagctcaagccgcgagggcgttgaattgtccggatttggggtggcggttaatgctcctcttctggtgcctcccccgctggggccctgcattccattagccccgcgctggggtagagatgccaagtttaggggctggagaggacaaggggaaggacgagagaactcttgcaccgacggatgtagttccaagcgacccgaaatgaggaaaacccagaaggggcggacggagggcaaagtcggcccaggacgatcttcaggcgc

SEQ ID NO: 698 - DNA, 500 bp, Homo sapiens
ggtgtcgccgcagctgaatgattgcgttggtggaacagctggcccgcttgtgcgtgggccaggacacggtggacctgttccgcctgcgttcttgccggtccatgtttggattagcatgtgagtttaaacatagtgctgatgcggcgattcttctagaagcacatccttctctgagctgaattgcttcatcacacacttccttctggcttggggagttccttttcatcaaaggccaagccttgtgtgtttcggtcctgcccatctccgtgcggcctgcgggacgttggttggcgtggagtcttcacagccggctgtccaggctggcagctctcccatcagggcttctcacagccaccgtctgtctgagcagacgctgagcatcgtgtcatccctcggacacacacaagactccactattccctgtgctgatttctgtttctgttacagcttctgcttctgattttattttttttttctttgagatgggagtctcgctctgt

SEQ ID NO: 699 - DNA, 500 bp, Homo sapiens
tctcattaccgacttttcttccagccggaggggaggaagaattcaagtgggggagggcgcgggaaggggacgtggagggaaacggaagggctgggagtggggtaggggggcagtggcgacctccggggggggagggtggcggacaccagaccccagggccgacagcccgggagggaccgggttccaggaccccagctgcacaaagccggcccggggagggggcgataaggagcgagcctcgggtcggcccggcaccgctgcttcggctcagagtccttgcaatcgcttggcctacgaacaacctaaatgaaatttagggttttattgaaaaagtcccctggggcctaatttagcctctcgactccagcctatatgcttacaagtcctcaggggactccggctaggaagtcaggagtggggcccgtgcgtccccggcaggacctagactgcctctcggcgcaggcggccctaacaaagaagcccacgaggcggtcccgggc

SEQ ID NO: 700 - DNA, 500 bp, Homo sapiens
aattttttaatagcaagtccacgttgaaattgtactgtcttggatattccgggttaaacaaaatatttaaattcatttcagctgtttctttttcgtttttaatgcgtctactagggagtttttaattgcttatgtagcctgtattatatttctatgagtcagtcttggttataataccgtgaaaaggccagccagcaacccagcccagccctggccacccccctcacaccctccagttcgcctctcacacggttccaaatgctctccagagccaggcaggaaacacctgtctggtggcttcctgtgacacacaaatacctaagtgtattcagaaatgggattcagaagtaagggctaaaaagagtttaacagattaaccaatttcaccccaagaaagtaagcacacttggggctgagatgtgggccatcttgttcattacccagaacagtggccggcacatagtaggcgagcaactagaatcaatcaatgcttttaaaaa

SEQ ID NO: 701 - DNA, 500 bp, Homo sapiens; identical to SEQ ID NO: 377

SEQ ID NO: 702 - DNA, 500 bp, Homo sapiens
ctggcagcaatcaatttcgatcttgttaaagcacaacgtgtcccagtggccggtatagattctgtcagtggagaacaaatcacggggctgcacgtgggcacctcgggggtggtgtgctgtgcagcctgcgaggctgcctaggaaacctcttcagcccaattctacaaaacacttggggtggcctcagattaaattgaattctgctgctctctccccactctccgccttcatttccttctttcctattctcgtcaaaagattgtttcctctgattgttatcaaccacctgtgtctggtttgaccgttatttcctgcctgtgcatgtccaagagggcgactccgtccttcctttccaagtctttgcacggcttccaacaagggaggctttgttggggctttctcagcttcagacttaggtgggtatgccagggtttctttaataaaacaacttcataagctcattgtctttctcaccagaaaacaaactctggtttttggaa

SEQ ID NO: 703 - DNA, 500 bp, Homo sapiens
cgtacttagatcctttcctctctctctctttctttctgccgcattaagttttatttaatgcagagttcgcttaaaaggttaagagagaaaaagaaagagaagaaagcaaatatggactgtgatggaaaaactcctaaatctttctctagaatataacgaagaaaacctcttcaaaaagatgaaagtgttcgatctgcctcctcttggcgcagccagcactcgagggtcaaaatggcattccccgtggcccgagccttgtctaacccggccgtgccgccacccgcactctcgcagagagcagggtcgcctggggtgggtgaaggggtctcagtcttgcactcacgtgaggacatagttgacgctgacgatacagtgtggcctggaggagcgactgttgtgcacgatggtcgcgtagctctgcacccatacccagccgccgtgtttcgccaggaacctgtagtacttggtggtcacctgtcccttcaccagcactgacggag

SEQ ID NO: 704 - DNA, 500 bp, Homo sapiens
tattgctgcttaagcactgtccacacacactgtttttggggggagtgaggtctcgtttcatttcctgtatcctttgtaacaagggttgttggctttagcagcagcattcaaacagttaagactgtcttaaggaaacaagcagcctcagccctccctccttccctttctcagccagtctctggcttcctcttacgatttcactaatggcagctcaaagctgctgagctctgccctgacggcatgcgcccccgcttctgtgagagcacgcttcctggcatgggggtcgaatcatgtcgataaaatgggctcggtttcatgaagtaccccacataacagtgagattcataggaccaaagcatggggaggtaagagcctgacttctttaaagcactaaattctagtaaacacagaaagagccagtggagttggttgttttgttttgtttccatcctgggaagaactaatttggattgttgcaaagggaagctatttcttattta

SEQ ID NO: 705 - DNA, 500 bp, Homo sapiens
ggatctgacggaatcttgaaggcagagttccgagactgcagtccaggatagagaagcccccggctccatcaggggctcctcggcttcaaggcaggacccaccccaaagctctcaaagcggcagaggcctgttttcaggtctatttttaaagatctctaggggaagtggtttctgaatgctctgtaggatgaggctgtgaacagtgattgtttcatttgctcggggctggcaaaaaagggatgtacaacccgttctcaccacaccagtgagttaaaaagcactgcagactatgaataccttttgccagttggactggttatggaaaccgatggcttcccctacaactggggaggctgccagcccgggtttcttgggacagtccctgaatatcttggtctagcttcgaatgcacttgctttatgagtcaccgttcaattaaaataaaagtggccaaggaaaaagaatcgaaggaaaagacacgaaaactgtgcagaggatcc

SEQ ID NO: 706 - DNA, 500 bp, Homo sapiens
ggaacagggacccagaggagtgaaaggagcagcagggcctagggaggggacggaggaagatggagctgggaggaagtaggaagctagcgtgaggggcgctgtcgaggcgctgaaggggggcacacaccgaggcgcagcccgcacccccagtaggctgagagggcgccggggacccgcactgagagtcaaggcagccccgcttccctacccatagcgccccccgggagatagtccgggacgcagggcccccgaggctgcgggtccaagtctttcagccaacccgggattagcgagccagccgcttcaaaagtctaggcgagaggaagccgagacgcgtcggccttcgccgggctggagcccctgccagatttagcctcccgcctggccttttctccggcctgcccctccgcccttcaaacgacgcttccacacgccccctccccgcctgtttcccgggcctcctccggggaaactggcgctcttcgcccacccaactcccc

SEQ ID NO: 707 - DNA, 500 bp, Homo sapiens
ccctgctctttttaagttcgaccacttcttctagttatgaaaaaatccatgtttgcaaccatccttctttctgtatcatttagttgttaccgcagaagaatttagaagagaaaatgaaagttctcctttgatcccgccccccaccaccgctgcagttaactctccctgcggttcccgggctcgctgttttaaaggaaggctaggatgcaagctgtctgtaaggctgttttgttttcacttggcttacgtcgtagacaggtctctgctgggggacggagatgaccaccggccttcccaaggctgcataagatttcctttgactatgctgtgatccatttacgcggcccccattggacaattagggcctcctccccgccccccaccccaccattgcaggtataaataaaagctgcgttggccgtcgatgtacctcctggagctcctgattatcctgtaggatagatccctggaggggaagcaaccaggcacgtgcgacattt

SEQ ID NO: 708 - DNA, 500 bp, Homo sapiens
cgcgctctgtacgaggagacggagcagcttcgggagcagagccggcgcccgccgagtcaggtgggcctcgggccccgcccctcccgccaggcccaatcccacctcgctggcctccctggctccgccttctctgaattaatccctccccgacggccccacctccgcgggtccaggctgccctcagcccgaggagatcccactgggcctcacgtatcacccccgtccggtcttctccacccgaccccgctccgcccgggcccactcccagcccctggccctccgtgtacctcttttgcatggccgagcggccggcggaggctcagtggtcctccgtgcgtcccagaacttcgcccgcggggagcggagaagccgtctggagctggagctgcagagccgcgagcaggacctggaacgcgcgggcctgcggcagcgggaggtgagcacccggcccctgccctgtccccacggtcacccgtgcactctccccctgtgccttagcg

SEQ ID NO: 709 - DNA, 500 bp, Homo sapiens
cagctgtgctgtgagtgggcagctgggctggcccctcctctggtgctgccaacccgctgccaggcagaggggaggcccagaggagagggaagctgggcaaaggggatggaaggcgtccagcccgaccttaccaaaccccttgggcctcgtgggaaggggcctcttggagagggggactgaggctctagacaggatattcactgctgtggcaaggcctgtagagagtttcgaagttaggaggactcaagacggtccctccctggacttttctgaaggtagaaccagcctcataagtaactaggctgggtgaacgggggcgctggctagtttatggatcacagtcggctggtgaggccacgtgcctactgtgtggccctgggtggccccgggcaagcccctttccctctcaggacttccatttcttacctgcaaaattgtggagagggggagggctgaaacacatgactgccaagattctttccagttcctccgtcagggtt

SEQ ID NO: 710 - DNA, 500 bp, Homo sapiens
tctggtggcatctgaagcagccactgactctttagtaccaggtatttagggctgagctcagggcaccttccctgggttggggcagaggagagacagatgctgtgacctctcctccccacgcagcgtcaaggctgagccagaccctggaaggtcactaggtgaggctccctctacggcccactctcctcacacagccccttccacaccccaagcacaccagggtaggtggatgactgccggcgaggcccccgaacgcctgcttctatgctgtacagaagctcctcggcatcttactgcagctaaaggcacatactagtcttgggagtagctgcaaagccgggagactgtagaaggcaaggcagaaaataccaggcccctcccttcttgccctggctggataaaggatctgatccaaaccagtgccctttcctgctttctccctgcctcacctccccctgtaaatctctggcgtcctagtaccatcctatcgtaagacatcc

SEQ ID NO: 711 - DNA, 500 bp, Homo sapiens
ttaaaagcgttcaactgcacactttatctctgatagactgtggctatgcctgctcttgacgcaggccaaagagagctgtggggtctgcacattaaagaatcagaggttttattttttccttccccccgacaaccaaagggtgctcaacaacatgtggctgtaggaaatgatgctcccagcccagcttcctcactaagaaaagggcttgagtgagttcagaagttctgtccaatataaataccgcatcaacgatcccctcccatgagtcacttcctcccacggagttcatcacaagtttatttcgttcccatattatggcaagattacgccataaatttacagagatcggccggctgtgtggcattgtttgggggcctcatcttttcccaccgtggtctgcatctggcacctgctcaaaggcctcttttagtccagcaatgacagcgctacgatgatctacagccacgatccaaacccgtggctccacgtgggaaggggga

SEQ ID NO: 712 - DNA, 500 bp, Homo sapiens
tgtccttggggcagctggggtctttgggaccctccaccgggctcgccggtccgtcggacttttggctgagatccgtgtcagactcctccgaatagtcgtctgttggcatcgagggctgaacccctgaggtgctgcatgaacttgaggtaaccgttgaagatgaggagagaggaggaaaagaagggggcttcgctgccgaagcccgggagaccacttgcggccaagacttcctggaggcgtggggggaagcggaggagggggcggcggccgacgggggaggggggctgtcgtttgagtgagcggcagactgcgaggtagatgcggtgctaggatcggggaagcaggcagagtgaggtaataaactagggtgctctttggcgtttcttgctgctctcgtgattgttctgtgtttgtgcaaggccgactcgagatgttgactcagagcttcctccccacagagcgcgctctcgcacgccaggcagtggtacgagccgccgccg

SEQ ID NO: 713 - DNA, 500 bp, Homo sapiens
gtcacaaggcaaaatgagaaggcgcacctcctccaggagccccctgaatttcttcagagaggagagccaggagtttctggagcccttggcagtgcgttcgttgaaaatacaactcagattacactgggttctaagaaaggaaaaggtccctattaaagaaacgggaagagaaagccagtttgtttacaagcgtgtaaagaggactccctccatcacttccttgggtgagagatggggcttccctgaacacgtgatctcacccacactccccacacacaccacaccctgtggctgcttctcttcaaatctccagggggattcagcaatattgaaaactcctattcagctgtcactacccagctgtgacacttcttctggaacattctctgacacacccccttcccacctaccctctggtttagctgcacctactccccaacttatcacatcatacagtttgctgtctataagcctgagggcttcccctttggactgtggaa

SEQ ID NO: 714 - DNA, 500 bp, Homo sapiens
gatctctgaggtgagaggcacgaccaaataggagagttggtgacatggaagagcgtggggttttccacactaggcttctcccgcccccaactcagagcgtcctcttccaccccaccccagcgggtgtcatgggtagaggcctcctgagttgttacagggaactctcctctcccagaaccggaagatggtgccggtacccgagggggcttacgggaacttttttgaggaacactgctatgtcatcctccacgtgagtcgcttggggaagtctgcctgagaggggtggcatggcccggcactggggagactgaggcacaggcataaactctgccctgggaagcggcaagttgagagccggagaatcacatcccacaagggggcggttaccgttgaggcttcttagtccttccctcccacttcctgatctccgcggaagcccctgcctagcgtctccccatggcccttggtacatcctccccttctccacccgcacctccgtc

SEQ ID NO: 715 - DNA, 500 bp, Homo sapiens
aagtcctgatttctagggttgcggggtgtggtgtggagtgcgaagaagaaccgcacctcggttcctaatcccctgcagggaagaaacctaatttcaagtggctgattcagccagacccttctatttcatagcgcatggggagggagaactgctcagaatctaaaatggaaattgtgtgaaaatggacggaagctgcagaacctctgtgcattcaacagtcacttcctgcgtttttgtgccattgtcacacgttgtgcttcagagacgccagaagacctgggcaaagacgtgagaactgcagccatcagctgatcaatccaggttttgattttaaataaggatggataattgtgtgaaagttctagacctatttttgacaaaagttgagggaagataaggagggaaaaatgttccagtgactatccctttgacatatatactccgattatataacgtaagaagatgcatatagttcatttctttcctctagtgtggtacct

SEQ ID NO: 716 - DNA, 500 bp, Homo sapiens
cgccggcgcctacttcctctaaggccggggctgactttcaggaaatgatgccggccccgtaagtcagggcaattaccggcagtgcgaggagaattactgtacggggcggatctcccacaggcgctgtcaacacgcaaccccacccgtgccccgccgcaggaccagccccctttggggcacccggcggacgtgcagaatgcccaggtgggcatgggcctcggtctccccagactgcagggagctgggttccgttccacggggaccagctgctgttcctggtgcccccaaaccacaggcagggaaactgcggccaagaccgcctcccttcacccagcaccccacgcatgccaagcgcacctcaggccctgctgcgcccccctggggctctccccaccccacccctgcaggctgaggtccccgagaagcccctgccgccgaagcaaagtcccctccctgctctttccctgctgtccgtgcccagggggttcagcgggccccgt

SEQ ID NO: 717 - DNA, 500 bp, Homo sapiens
acaaagcaaagcagcggagtccctggaggagctgcgggcctgcatcagcaccctggtggatcggcaccgggaggcccagcaggtgctggctcggctgcaagaagaaaaccagcagttgcgggggtccttgtccccgtgtagggagccaggcacctccttaaaggccccagcatccccccaagtggccgctctggagcaagacctggggaagctggaggaagagctgcgggcagttcaggccacgatgagcgggaagagccaggagatcggaaagctgaagcagctgctctaccaagccacagaggaagtggctgagctaagggcccgggaggcagccagcctacggcaacacgagaaaactcggggttcgctggtggcccaggctcaggcttggggccaggagctaaaggctctgttggaaaagtataatacggcctgccgggaagtgggtcggctgcgggaggcggtggccgaggagcgccgccggagcggggacctgg

SEQ ID NO: 718 - DNA, 500 bp, Homo sapiens
tcccaggttcaagtgattctcctgcctcagcctccagagtagctgggattacaggcgcacgtcaccacacctggctaatttttgtatttttagtagagacggggtttctccatgttggtcaggctggtctcgaactcctgacctcgtgatccgcccgcctcggcctcccaaagtgctgggattacaggcgtgagccaccgtgcccggccgggaggtcactttaaggagggctgtccaactgcaaggagccgcaagcaggaagtgaaaccacagcacttcaaaaaaagagggagactgggacaagcgtatctaagaggctgaacatgaatccacagatcaggtaccgctgcccactatgtccgcagggcccctccggccccttccttctggtggtcctgctgggcctcagccctggcctccccctgccccagccccagccctggacttccttccctctggcttccctgccgcccccactcccagccagactccttgccctg

SEQ ID NO: 719 - DNA, 500 bp, Homo sapiens
acttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggtgaggcggtgccgggcggggcagggtggggccccgccgcgccgcgccccgccctcctggccgcctgacgcccgctttcccaggcagagctggtgcacgaggacatcgagagcgcgttggccgactgccggctgggcaagaagatgcggccgcagaccctgaagtagggcagcgggcggagcggggtcgcagggggcggggaggggaggagcccggcaggggaggggaggagccggcaggggaggggaggagcccggcagggagggagggtcaggtgcgttcccggcggggctgagcaggaccccctcgccctccaggggacaccaggagaagattcggcagcggcagtccatcctgcctcct

SEQ ID NO: 720 - DNA, 500 bp, Homo sapiens
gtgtatctcatcttacactccccttccgttccccaagccgaatcagactacccgtgtctttccgctgctgctgctgctgctgctcttgggttagggtccatgtgcgcagccagggttcctattcatccgctgccttcctccggaacaaagtggctccccatcgtgccaggggtcttggagcgaggcccgcgagagtgcaaatagcttcactcacacttaacagcaccattggaaaaataactaccaagccgggtccctgagagtccctaaacgtgccttccgatttggaactggcgttgtttggcgggttgcacacgccagggactaatttgtacaggcgttaattggtcctccgtttgttctgaagccaaacccagagggttcatctcctggtattgatgcaaatgaaacccaaccaaacaatctcctccatagaatccccagggggcatggctcctgcaaggtcgtcctggcctccccttggggtccagggcttaagg

SEQ ID NO: 721 - DNA, 500 bp, Homo sapiens
tgtggctgggaaagaccggcaatgccccaccaggccgtcccattaaccctgccgagggacctgccgcgtcagacttcatcggggaaaagggcgggacacgggcggtcccgggtgcctagaagcctccttttcgtctttccgccgtggtggaatcatccgcaaggtttaccgaggcgacctccggagcgaaggtttcagcagctaccggaggcttccagcaaacacggcgcagctgccccgcgcggcagtcgcagtgttcacagccctagggttctccagctgtgcctcgtcttctctggggcccctttcttccttttccttgccctcaggaattcccctcaagtcatatccaccagccatcacttccgcttggaatgaaccacggccaagtcactcaccaaaaattataaggaggaaaccatttcggccacttgtgtcacgtgcgttgatgtgacacgtgtggatgtgaagtttgagatggtctgcgtcacaactcgttg

SEQ ID NO: 722 - DNA, 500 bp, Homo sapiens
gtgctgtcgctgtggtttttaggtgtttaaggaagaagtggacgaaatcatccgtttggttatagagaatacctttccttgtgtgtgatggctggcaagagtagttcggggatggggaggggagaagcaatgcccactgtcttcgctcagtacctcatgtacactggggtgtcgttctctgggacccgtgcccgacctggacgatgtgaaggaggccgtgacctctgggaggatgcatgtttttaagaacgactctcccggcctaacgcaaggaccttcgccctgttttcagcccaattgctgttcgtttttgctgcttccctggattaaggagccatggtcagggtctattcagaggccagccggcaggcggtccccctgtgacctaaccatcccctgcacctagcaatcctccttcctggaatttgtgtaacctcttattagcataacgaaaacaggtaccttggcagtcacttagtgactaacaagttccctttggt

SEQ ID NO: 723 - DNA, 500 bp, Homo sapiens
agaagggaaaacatttcagccactcaaagttttgtggtgaaattataaactccagaaaaactgaatttataatggaaatgctgacagacctttcagtggagcagtttgaacgcaacactgtaatttggcaatctctcttacagactaaagactaattctaacaagatgtcattttgactcacgtttattattacctgcaagaatgaaaaacgccgtttactcgggaggtgcccgagaaccagggtggggcgatctcacattttaagcaagacgcccgctgccttaccaaaatagccctctccgccaaaggaggggcagcctttcacgctcagcttctttcatgtcagcccgagcctttgcagcaagacgtgcctttcctacatgttacattttaatgatctgagaaaaccgttatcagcgttaacatctctaattttactctaaacagacaaaagcaaaatatctcattaggcatcatctccgccaaggttcccactagg

SEQ ID NO: 724 - DNA, 500 bp, Homo sapiens
tgaaaaaatccatgtttgcaaccatccttctttctgtatcatttagttgttaccgcagaagaatttagaagagaaaatgaaagttctcctttgatcccgccccccaccaccgctgcagttaactctccctgcggttcccgggctcgctgttttaaaggaaggctaggatgcaagctgtctgtaaggctgttttgttttcacttggcttacgtcgtagacaggtctctgctgggggacggagatgaccaccggccttcccaaggctgcataagatttcctttgactatgctgtgatccatttacgcggcccccattggacaattagggcctcctccccgccccccaccccaccattgcaggtataaataaaagctgcgttggccgtcgatgtacctcctggagctcctgattatcctgtaggatagatccctggaggggaagcaaccaggcacgtgcgacattttggtgacacaggccaagctaccatgccgaaaagttta

SEQ ID NO: 725 - DNA, 500 bp, Homo sapiens
acagtcgcaagatacttttttgtcttatatcttttgacatttattgggacctctccgtccccatattacagtcacaagctacattttattaaccgtcggtaacgttaactgtgaatggaatcgggaaatgaaaagaaaaatgagcccccctccatatacctccaaccatattagatctcaaggtagtcaataatgagtgtttgataccaggaagcctcacttcggaagtcacaaagagctggttacgctcgcctagaacccggcagggaaggccgccgttctccccggaaaccgccgggcgaagtgctgaggaggtgcgatgagaaaccaccaagtcagaaatcgtcagcgatgtggatgactcgggaaacttctctgtctgggtctgggagtatgaagatctataagaacctctctgcacacagaaatccaagagctcacacgctacttagatgaattaagcacccaagaggatatatttaaataccttcttgcttgtg

SEQ ID NO: 726 - DNA, 500 bp, Homo sapiens
tcaccgcctggaagtccaggagccatttttagggaacagcattcaagctcaacatggcaagttccctctttcctgcaggggaggaccagaagggagccggagatgggggagaagggtgggaggtggatggtttggaaaagggatggagacccagacggagagaagccagccagccagggtgagggaacaagctgctgtgctgcccaggagaggcctggcctcaggctgccagcctcagggaggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctc

SEQ ID NO: 727 - DNA, 500 bp, Homo sapiens
ataacatgaatgtaagctcatggtttgtagaagtaatttactgacatttattctgctgtcatgagtatggctagtgattcacgttcatgaaaaacagatgttagggctctgatttagaaaaatgacttcatgttagttatctgactaatggggaggctgagagccactgtgtcctccccgtctgccctcagccttgtgttgtcatccctgtaagggtttgtctctgtagccccaaaccacagtgggaggcgcagctagtgaaccttgcaacagactaacaccatggagacaaagtaaaccatgtttgggtgtggccccaaattggctaactgttctggcattttctggttagctatgattctgatgttcctagaacaaaattagaccatgctactggcctttcgttcttttctcaggagtctcctatacttctgagaatggatttttagatttcagacatgtaattttcattgagagggcacagaggaagacaaagttat

SEQ ID NO: 728 - DNA, 500 bp, Homo sapiens
tgcacctgcccctcggggtgggtccccctctttaccctcgcttccccccgcgggtgccgataaaggcggctaattcccgagcccggggagggagggggcgactgttccagtcaacacttccccgcgctcttccccgaccctcccagagcgttcccgctgctcagggcgaggagcagctgcggccagtttgtcctagcggtttaggaggcagggaggtttcctccagcctggagctctggctcgggccctcgggccccaacaccttcccgctgagaccgcgggcgttgtccctgggtctctctgcctccatttcccccacctccattctggttaccccttccccccactctttccttcctaacccatgagagcactggaaagatgctagaaagtcgggcttctagagccccagccctgcctcttgttcctgcgagactgtgggcaggtaatttagcctctcagcccctttcatctgacgctgggaagtaatgaggagaccc

SEQ ID NO: 729 - DNA, 500 bp, Homo sapiens
agaaggaggtgggtgcctcttgcctctaactctccgttttctcatagcccccactttgtcactccccaagggctcgcctagcttactccacccccgttttgttccaaaggcaagttcagtggtctcctctctacccccatctcatctgcagagaaaggccaccctttaatgagaagaccagagtgagaattagaagttgagttggccgcttactcagtgtttttttgtttgcaaatacctttctaacaacgataagcccctcccaagatgccccagaagttctaagtgtcccttgctgcctcccaccctaacctggcctcctgcatataggatttcttttctatttctgctgaaacagtttagcctattcgccaccccttcctgtccccccaccttaacccagccagcctcccctttcctgtctgtggcaggagcgtgcacaggtcctgtccgtggcgcatccgccctgaatcacagaaaacacgcaccccgccgtcagg

SEQ ID NO: 730 - DNA, 500 bp, Homo sapiens
agctgttttactgactgagaaattacccctgtcggccgaagttttattcttctgatttggtagaggaaatagtttaaaaatgatctcacagcgtgatttatgtaaacggcgcttctttctttggatgagacaattgagatagagtctgaaaccctggcaagccacagcttcctgcagtgtcctgttgccatgggttacgaagggagcgagagggaacttcatcggaaatgcctttaaacttttctcacacgcacaagctgcggtgttgaatggtgtgtcttagacccgggtgcctagtgtggctcggtgccttacaatgaatttggggaaagagttgtcaaacgaaacccatgtttctaatgaccagcaggtaagtagttccggctttttcttttcatttaatcagtggtaggaaagcgtggcaccctggctatcctgttttagcgagtggcagctgtgggacctgcaaatgcttgtaaggataagctttggaaatggtt

SEQ ID NO: 731 - DNA, 500 bp, Homo sapiens
gtggcctgcaccacacctccgacgcccaccagcccggggagtacaccgaaaaccagcggggcgtaactccccgcgctcagcccataggccacagccgcggccagcaggggacccccccagctctcttcgccgcccaccacgggcaccagccccaccacccacagccccagcccagtcagagccccgaatacggccagcagccgcgggaggggcacccagccttggtctgccagccacccgcagaccagccgggcgcccgcatcccccatcgcagccacggccaccaccagcgctgctccgtatccccccaggccccggtctaaagcgtggggagccaagtgcacgtaaggaacgaagtacccgcccccaaccagggctgtgcctagagcaaagattgagaaggcccggcgtgtgaacagactcaggccgagggcagctaggggactacgcggtggggctggggggtctccaggaaggaccaggggtagcagcagggcgcc

SEQ ID NO: 732 - DNA, 500 bp, Homo sapiens
ccattttcctcctcattgctaacatgataagcaatgcaagtttttcctaatagaaacaataatgtacaaagaacttgattcaaattaaattgtctcattactttgtaataaatcacccacaagcatttcctgagcactaccaggcatgttacctgccaggaacggctggcggaggagacagatacggcttaactgcgctcatgatcatgacggggtgtgatcagcgctccctgccgagacgaacggaaacgtcgtctaggagggagaatgctaggagggagaatgccggccttggaagctgagcaccccggtggaaccccagcttccccaaaccagcgccacgcccctggccaagttcctcaacctcgtcgagcgccagtatcctcacttgacgactacagatgtcaaccacagcctggagaccacagtggggtgggaagctccttgtttaaaaggcccctggccaggattcagcactcagcaggggctggaaggctatt

SEQ ID NO: 733 - DNA, 500 bp, Homo sapiens
gtcctgacccttctggagggagatgcactgtgtaggcgattgtcaagaattcccaagttaattgacaaaatatcacatacaaatcatttcaatcagcttgggaaagaaaactggggctttaggtcagggaagagctgaaagaaagcccctttcccttcccctgaagattgtcggaggcagcttaccactgcagcaggaactgaaacctttagctttagggctccagttatcactctaatcaagtccacacgcaaagaaccaagcagaaaggaaaactgaaagtgagatgtggagaggcgataccggaggctgttctctcctaggctcagttccttagagagagataatgtaagcatcgggtaagtaggggctggagccaaggggagcgaggaacaaaggagaaaacctctaggtcaagagagtagactgggttactgttctggggtatttaaggtggagaggtggagaagtaaagaaaaatggtgtttcttgactgggca

SEQ ID NO: 734 - DNA, 500 bp, Homo sapiens; identical to SEQ ID NO: 456

SEQ ID NO: 735 - DNA, 500 bp, Homo sapiens
agcacatccaagcgtgctctcccctctccttctctccctctctctctctctctctctcacacacacacacacacacacactcaacacacatacaccctgggctgagctgctcttgctggctgcagccgtgggcctctgctcaccgtgccgctgctgctgcctgcgaaatgacggcggttcccctcacttccaggaatccacgcttcctggaaggtgagtggctgggctcacccctgcctgccactgagacgcagacatgcatacaccacccgcactccctcgccgtttccaaggcggcggccgcgttcgcaccccagggtctcaccggcaagggaaggataatgtaagttcaggcagaaggcggctagtggagggaggaaggggggtgctggggctagggagccaattcagtaactactcccaagcctgaggagatggagaggatgggggctgtgtgtgtgtgtgtgtgtgtgtgtgtgtgtgtgtgtgtgtgtagcggg

SEQ ID NO: 736 - DNA, 500 bp, Homo sapiens
gggagcaaaagagagcgcaaggctctagactccaagatcgggcatctctccctctccactgcacaggggacttgtgcccgcagaccccttctgagatttcttgcctctgtagcgcgaaatagaaaagatggaaaatccaaggaggtgaattggaatttttacttcttcacctattaaaacactgcagatttcaaatcaaagaactcgtctgcgggagtgtctggattttgtgagttttgtgcctgtggccgagtggaagcggagaggagtgagagcgctgggcgacgcggccagccaaggcgaggccggtccctcccgggcttgggctctgtccctgcgcgtgagccgcctgcagccttccgaggggcagcaccgcgaccaggaacacgcgaacgcgagtccagacccgggtttggaaaaagggaagaaggagaggaggagaagggaagttaaaaagagagagagaaaacaaggatgaacgatggggagaagggagggca

SEQ ID NO: 737 - DNA, 500 bp, Homo sapiens
ttatgattttaataaaattgtctcatttaggagcgagcttctgcgctgcctctgtcgtcggagcccgggtttgccacggcaaagtctgtaatcagagaaaaataccagctttgttgagggttagaatatatcattggctaatgtgtgtggttttctttttaaataatgctaagcattggaataattaaagagtgagaaataactcgtctctcctctctcctctccattcagcattgtcttatttaagggcggaaagcgcgcttttcggcagagctggttagtttttaatgcgggctttttttttctcacccgccgttccctccgctccggtctgattcgcaaatccccaaactggcacaaaccgggaaacttgcggccggccgttcttctccccgagttggagacagccctctcctcttccctcccccgcctctgggccctgacccactgcctggtttgcgctagagccgtttaaaaaagaaagaaaggaagaaaggagc

SEQ ID NO: 738 - DNA, 500 bp, Homo sapiens
tcccccggccggggcaggtggcggcccgtggaacagggattcccgccggcgcgtgtgcgggctctcgggcaggaaggcccagccttcgcggcccgccaggtgaggcagcgagcaggtcgcggggaggccgcgccccgccacgtgccgccgggccgcgggcactgcgccgcccgggtccgggagccgaggcgggatgaagaactgcgggatgcgatccggggtgaggacgttggggcaggcgcttgtgggcgggcccggggcgcgacgcttggagaacaggccggaaggcgcccaacgggccgcaggctccgcggcccccaccttatagccagctttttccaagagccacatgcggtgggtggggtaatggaattccgaattccgcagggccgagagggtccaaatcccgtctcagatgggagtgctcggcggagcggggctgggcgaggagcgcagaggagtcagaggtgagtgatgctggcgtacaccgggcggtcagc

SEQ ID NO: 739 - DNA, 500 bp, Homo sapiens
tgcgtgtgtgtgtgtgtgtgtgtgtgtgtgtgtgtgtgcatatgagagagagagagaggaaagagactccttgcaattgtagggaaatgcagtttacccctgacacctactgtgtgacaatcattgagtttcccttttatgcacacctgtggatgcatccgcccttttctgaccagaggctgctctgggtccactggggcctaggaagttggaggtcaggtgtctgcggaagcaaaacaacatcccttccgagtctcctcgcccctataacagtcccccaggctcctcccttcactctgccttcagctatcctggttgggcagccgcagggtccgcccttgagtacttcctctttgcccagccctggagcaaaaactgggggcgtggtccctgccctgtctgtgtgccttgagcctctcttcaggattccggcccccaggccctgcccctagatctgtggctgcgggaaagtagggcaggtctgtgtttcaggctagagg

SEQ ID NO: 740 - DNA, 500 bp, Homo sapiens
taaagttgaagtagtaacagatgaaaagcctacaaaagtccccggactttcaaataccacatttcagtcttagcccagaaagcaggatttcgccccacaaaggaatagtcaaggacaaatttcctggagaaaagttttgaacttttagaacggggaatccgctgacctcgctgagtaagtgagaaggttgattcactttttgtgctgttggaacagggaccagtgttggagatgattccattaatcttgcgaagtgatcagtcactgggaggattgaattgcatttcctgcctaaagatagagacagatgacctttgctgcagccctcagacccccagttcacagctggggagaggatgtgtcagcgtttactttcaggtctcaccctgccctttgttcaaaattcagactcttttgtgtttaggctgctgctggggtttttgtagttgttgatgctgcttttttttttttttttttttttttttttatataaccgccca

SEQ ID NO: 741 - DNA, 500 bp, Homo sapiens
aggaatgaaagaggtgccagaggagtcctgactaggaggctgagcagagcaggtgggtggagccctctgtccgctgtgagcagggagttaagcctttctaggaaggatgtttctcatgcgtagacggacttcctgcctttgtcccagttgtctctccctgggttgtagaggaagtaaatattgctggatcctaaagtctggcatgtgggaaggagaggcgtggagtctaggactggaactcctgtttctcggaggggctccttcaaggaagcagcagcagtgacccagctgttgccagctgcagtggaaattctgagctcaaagtctcagctgctagaccacagcaagctccaccctggggccttcataaggatagcagcacttgtgtcctctgccccacagtcagacttctcatgagtccctcccctgcctcaatttgggaatgaatccaagtgtgtagcctggaagggctaggatagccacatccatcctcaccctcc

SEQ ID NO: 742 - DNA, 500 bp, Homo sapiens
gcggggaggggagaggaagagaagcgctgtgggcctcctgcacgcatgcacacacacacacacacacacacatacacacatgcacgcacacacacactctccctgcaaagatctaaaaacccctttcatctcaataaaggggaacagtaacagacacaaagacaaaggggaggccagcccagctgtaaaaaaaattaagagcgtctttgcttgtgctctgctgcaaggatctgggctgaacaatagagccgggcctctgccagccctcccacaccagttagtcagagcaaaccagtcctcctcctctctggagagcagagggcccacatggtaaggctaggaacagttagcaaaattgctcccagaagtacctatgactactcagagtcacactctctacggattgcacaaaacaaccctactatgacatcattttctagtcacagggacggagcaataaggtgtgatgcgggtgctccaccgaggctgtgctggcaccc

SEQ ID NO: 743 - DNA, 500 bp, Homo sapiens
tgtgctaacagcccagatggagccatagcctcaacctctgtgttctgataacaccaagctgggacgccggagccatgcaggggacagtgcccggcctgaggctgcagcctgggtctggatgcctttctaattcagggcctcctcatggcctggttccataaatggtcaaatgcagcctgacagcgcagcctcctatcagcgctgggctccgtaccgccacacagcccacataccccgttccccaggagacgcccgcaggtgggcagcgtcactcccacccgccgagcacacgctgtccccgtctcgtgtcccgaggagccggaagcagctgcttcctcccagcctgaaagctgcacctcgggctgcactcggctccccgaacccgccctccgctgccctgcaattcgccaagggagctacccttcccatataaaaatttcacctccatttccttgtagagaagaaacatttctgacagcaaggaagattctaatttgaaa

SEQ ID NO: 744 - DNA, 500 bp, Homo sapiens
agtttggaccgatagatgtgagtccccctctggggggcactcactttgtggagcccccggttcctgtttgcagaggggggcacagtggcacctcgtccgctgtggagtgagaacagggacccgaccacgtgaagcacagagaatgctcagggatcggcagccgtgtatccagccaacatcaccagggtgcacgcagagcctggcccgggccaggtcctggggtgctgagcatgggtggggcctgagagacggctcagggaccatcctgggagggccgggcggaggggcagcaactggggctcaggctcaggcagtcccagcagtgactgggaggcagctgtgcccatgaagctgtgcccttctccagcctcagccctcagcccggcttcccgggctggccccgccactcagcagcccctccccatcctccgaaaacccaagctcacctctgggttccggctgggtgggggttgccaggagacggttgccaggtcaccact

SEQ ID NO: 745 - DNA, 500 bp, Homo sapiens
ttttcctttcctgcagtaccagggaaaagggcacaaaaagcccagaaacatgacaagtgagtgcatataattcagtcaaccctcacagtccttaaaaccacaaaacccccatgaagcctgtgcggctcccgaggccacatgaccggatcagtgaggctgccagtactcagcatgctgccgttagagggagtcccccctgcatgttaactcccagtaacaacaacgggtgctgtgctgatgacctcagaacgtggcaggctcctgggccatcgcagtgactcacagcagtcctaacagacaggcctgctgcttcctattgtgcatgaggaacaaggtctctcaggcagagctgcaaacacccacatggtgagtccaggacagggcctcacatgtggcatcatcgccagctcaggatgggcaaagggatgcatggcagacaggcatgctggatactaattgtgaccttacagttgtcaggacctgtactggtaatcccagtc

SEQ ID NO: 746 - DNA, 500 bp, Homo sapiens
aacgttaactgtgaatggaatcgggaaatgaaaagaaaaatgagcccccctccatatacctccaaccatattagatctcaaggtagtcaataatgagtgtttgataccaggaagcctcacttcggaagtcacaaagagctggttacgctcgcctagaacccggcagggaaggccgccgttctccccggaaaccgccgggcgaagtgctgaggaggtgcgatgagaaaccaccaagtcagaaatcgtcagcgatgtggatgactcgggaaacttctctgtctgggtctgggagtatgaagatctataagaacctctctgcacacagaaatccaagagctcacacgctacttagatgaattaagcacccaagaggatatatttaaataccttcttgcttgtgcactcttgtcctgcttgaatttcttttctccatgtgcatgtactacctagcaaaatataaacaatacaaaatttatttgtaactgaaggcggctctgcct

SEQ ID NO: 747 - DNA, 500 bp, Homo sapiens
agcccgcgtcccttgcatgattgttgtaagaaagccccagctcagctgcgtggagacagggtcctcttggctgcaaattctaaaatcatttttcctatgaagagagcagtgctaattttttccaaaatatatcagattatgatcgacttgactgaagtgtgaaatgaaagtgggttggagtgttcctgccaaagacaagcacggctgccttgccgtcgctcgtgccgtgctctctaccctccacagtcacggtgccggaccctctcccgataactggacacgtgtctcccacaggacacgcactggcactaaatccacactgcccatctcggagacaggcggaggaactcccgagctgagatgcggaaagcaccaggccgtagggacctcaccgcagcgggccgcagctcaggactcggagcaggtgggccacaccatgccgcatgtttccagctgccaccgcagtggttggacaggatctgggtgtcggagcagctctg

SEQ ID NO: 748 - DNA, 500 bp, Homo sapiens
gtcacgtgggaacagaggcctcagtcctccccgcagagattttctgtgactgcttccatgagacagagaaaaagagagagggctgttaagggaggtggaggccatcccagggcatctcttgccaggctggcaccggcatcgttccactgggtacataatatcccataatagggcctggctgtttggagtgcacagagacagaaagaagattgacatcgtacgagtgtcgggttccgagactggcgtgcccgccggcctctccctctgtgggcggcctccgctcacccacgagagcagctccggaggcaccacctcggggaagccgactatgctggggtgagggcccccccacccagattcttgtcacccagaacctgtgagtgtgaccttgtttggaaatagggtctttgcccatgcatgaagttagggtgaagtcatactggatttggggcctatatccagggactgatgtcctcacaagaagaaggagatttagagac

SEQ ID NO: 749 - DNA, 500 bp, Homo sapiens
ctgcactccagcctgggcaacagagtgagactccgtctcaaacaaaaagaaaaaaaaaagaactgaagagtgcaagctcgcatttaagtgtcagggcatctgagtccctaggcaactaggagctggaaggtgagagggaaactggagtggggacgagtgagagacagcacagccacttgggttctacgaggcatggatgtcagggtccccatacccttcttctcgcctgtgaagggcaccaagtcatcacgctctttgacttctagtgcctgttgctccaagtactgcaaaagggcctctcggtccagtggccccgttgggctcttctttgtctggtcacgttgtcttagtccagctggcaggagcatgttcttagggatgagttttggggagcaagtcagacctcccctctgacctaggtactgctagggctccctaaaacatcaccggacacctttcccctggccttcttaggaccctaggtcctgtagcaaacccta

SEQ ID NO: 750 - DNA, 500 bp, Homo sapiens
tatgacctgcttcggcccgggatcacgaaaggtttgggccgaatattatgcttgtgttcaaagtagttcccgtcctgtgaaaacaaagcgttaaaaaggccctcagtggaaggcggacactgttgcagataagattaaacgaacgatagttgtacagggaggatcatttaccaccaactactgtcataactaagaaaggcgatgacgggaccaggacgatgtcttctttccaaccatctatccgctaaacggtcaggcactggcggattggaccccacaacaattagaacatgttttagatgcttgtctttaaaagagaaatctgatagtgccttcaggaaagtaaaaataaaacagcaagagctggacttttgaaaagaaaagaaaccatgctatcactgttaggtacactgtggccagaacagagccggatacttacttttgaggtgagctaggaatgagaccccgcagctgtccgtgaagcgcatcttgtatattgc

SEQ ID NO: 751 - DNA, 500 bp, Homo sapiens
tacttatctcttttcttttttggtagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagag

SEQ ID NO: 752 - DNA, 500 bp, Homo sapiens
cctcctgctatgcggcacgcacgcaggcgtgccatttcagctctgggcctctctcctggagcagctggcaggggcatctgtgggtggtgaacaggacggggggccggagaccctggctgacctgtagcccttgggcctggaacttctcccgcttgtgtgcctgggttgcagattttccgggcaccttcttggtagaaggcaggcgggatctggtttcacggcgaattcaaaaggggcaaagcaacgcggcgcctcctgaattcctggccctgcgaacgtcatgtcgttaacgtgttatttatggcaccctcctgactctgctgtcatgttaggcctctgggtggggcattgtgccctcgccaatcaatcagccaaccaacccaataggcccactaaccagcgttaaccagctagcatttgttcacttatatgccgccaattattgttttagaagctgcaaagaatgggttcttccatatctttttgcataacctgcatgt

SEQ ID NO: 753 - DNA, 500 bp, Homo sapiens
aaaaaagagcgacttagcctgcatatggatatccagggatatgtctgttttcctgactgccccaatacactctcagtgtaatcaggaagacaaaacagtctcgccacattttctgcttctttctgtggaacggaatctgatgtctcccagctgcattcatgtcccttcaaagtgggcaacttggcatttactcccgctctctaaagagtcaccgagggcattggaaatttcggctgcgaacccggagagcggctggctctgctgcggccgggctgccgtcgctccactccagctgccgtttctttatttaagaagaactacagaaaagacctttaggaatcacctcttaagtcattatggcataaggcacctttctgtctttatgacatggtggggggggggggtacgatatttaattgaagattttatttttaattttcgcattcttaccatgtggtcattactttatttttacattttcagcccattttctttccagc

SEQ ID NO: 754 - DNA, 500 bp, Homo sapiens
gtggtgagggcctcggcggttgcgatgtgcatgatggtgttgtcactcacgggccattctcctggcgagagtacgaggtggtccaggcccccggaacgttgcagctcctcctggatcttcatgcctacagtgctgttctccttgcagacatttctgtagccaagagcatcgccgacgctccccagcaacatcgcagccttaaatttctccatcccaggaggcagctcctcttccccaacagctgcggagcgtcctggcctttgtctcctcctcagcccgcctgacttttatagtggtcactgtgtcactgtcaggagcgtcctctgatggccaggcgctccttgtctatctctgcaggtggcaccaatgagaggacctttctgtcccccacgtgggaggtgtcagttttcttctgcgtctggacaggcaccagctcctcagcagaggagcctgctagcttctgccggcagccgcagcacattcagagcgttgacagagca

SEQ ID NO: 755 - DNA, 500 bp, Homo sapiens
accactgatatgaatccagcccctgtctacagaggtggaggatcagggggcgtctgcaggagcatgtggccaggcatgggtgcacctagatgcggtgagcaggggtactggagaacagggtccctgacagagggatgcaggtcgtggaggacatcggccagggaccctggagcgccataaagctgctggggctgaggcaggatgaagtcggcacacgcgatgttctctgtttctcaaactgggggacggcgggatgaaagcggcacccaggaaggctcagcctggcacgagtgtgcgagctgaacggaatgtggacggtgttggcccaggacgcagctcagaggctgctgcagtaatcccggcgtgaatgaggctgtaatccccacagaatgatgtgctgggcaatgtggagcctggcttcatttccagctctatttatggctctgaattacaggaaaagtgggggagggcactgctcctgaagctccgtttcctcctcc

SEQ ID NO: 756 - DNA, 500 bp, Homo sapiens
taacgtgagtgccaaagcccaaacggaccacagactccagacactagtgacctttccattcaaccctgggaacgtatgagccaaaaaacatgctaaaaccagcgacagtagaatgcaatggtattcagctgctccatgccacacgtactcatgtctgcaaacccttgctagcgggcacctgccagaagcaactctgttacaggatggaatctcacaggttgttcccctacccagcacatatgcggctttcgctaaaccatctgctgctttgctgacaaggacagaccaaggaatttccatgctgcggtctgtcagcgtctgtcacagggccaccaccctttgattgggcgaggaacttggaactgagacctgtcctccaggagaccaatgtgaccctcccagggcagagggagtgctgccacttcacacgtcctctcacccgggcttatctaactggccacaggacaagttctgtgttttgtcggcctgggaaatctaat

SEQ ID NO: 757 - DNA, 500 bp, Homo sapiens
gtttaatgtgtgtcctcgtgtgcacacaaggaaggatggactggagacatttgtcctcccctacttttttcttgagccctgggggccctgtgcctagttctgtcccagcctgcctcagggctcagctattttaagttttcagggtaatatgagcctttccttcccttactacttcattcccttcaccccacccccacccccaccccccgcttcaatccaaactcatcctagagtagaataataattttacgcctaaaacccaaaagactcacagacaaggagagaaatgaagaagctgagtagattatagatcagggcagctggggtgagcagtcgtggaaatcaagaggatgaagaggtaacttacgttcgggattccctaagtcagtccacaggctgtagagggagctgggagcctcgaggccttgatggtggtgctggggaaaaactggtcctcttccttgggggctaagcccccccagtaccccctgtgttcacac

SEQ ID NO: 758 - DNA, 500 bp, Homo sapiens
aggagcagtggggccccaggggggcacccctagaaggagcgtgcctggcaggtgcctccatagtgccctctgccctcctgggggctgtgggcctgcttcccaccctccctgccatcccagttagcggagtgaacttggatggtcctggggccagacaggagtcacttacgccagctgggaggtcttgaacaagctgctgctgtatttctgcatgaccccttggaacaagcccattggggcccgggccggcgaactctcaggaggtgcagtggacctggagggtgcagagcaggagtgaaagagggaaaagtactctgcataggagaagcgggtcatggcttcaggcaggaatgaggatggagggagagccagggagagactgactgacagacacagggctctgaaccaaagcagatggccgggtcctctgtgtgctggacacagctgctgtgtctccggattatttttggcccttggaggaagccctgggagatttaaat

SEQ ID NO: 759 - DNA, 500 bp, Homo sapiens
gtagaagcaatcgtcacaaaccaatatcaggtggaacaagtaagagccacaggaaatctcttcaaggagaaagagatatgaggacgctgtcttgaaaccggagccttgagcatgcctcacgctggggctccccagcagctgtggcctggaaacccatggctttaattaagcaaaagagcgtttgcaacgccaagacggaggtggccccaagccactggcacagagggcaggcaaaggaaaatcggcacgcgttctgagtaaacggggcgctctttcgtgagtccattcaaggttcatgtggctgttctcaaaataacagattggaaaccgggtcagtaattgctggcccggcaccttcgaaatggccatttacatccttttctttctggaaagtcttaactttcatacagctgctcagaatatgcctacggaacattttcttaattgggtcccttaatccccaaaagttaggaaaaagaagtgccggacttggaggacga

SEQ ID NO: 760 - DNA, 500 bp, Homo sapiens
acagcccatgaaaacaggttgctctgcaattctcccaactgttcccttcccgcttcccacctgcctcgtatggaaaacacccaaagtaggcactgtttatagagccatcgcttgcagaacatctccccggcctccgacacatgtgccataaatgctgcagagctgcgtccacagtccctgctccggagaagagcattttgcttgttttcaaacacaagcatcctctcccgcgcctgggagggcgaggtgcggatcttttcgccttggcagtccctcgctcaaatgtgcgtctctggcaagtcctgtctgctgatagttgatagtgctgccacagagcggctgtcagattccaaaggcatcataccatctgcttttccaatcttctgctcttcaatgtagacatatgttcgagtggttcgtgtgtgtgcctggtgaggggggtgctattttccgggggaagaggaggaggagaggatgcttaactccaagagtcctcaaag

SEQ ID NO: 761 - DNA, 500 bp, Homo sapiens
agcaagataatccagatctccagtggcagagagttgagagtgatccaggaaagtgaagcaggagatgcgggactgccccgggtggaagtgatcctcgactgctctgacaggcagaagacagaagggtgcaggcttcaggcaggaaaggagtgtgtggattctccagtggaaggagggcagtcagaagcacctccttctctggtatcctttgccgtctcatcagaaggcacagagcagggagaagatccacgctcggaaaaagatcacagcagacctcacaagcaccgagcgcggcatgcacgtaagttctgcctgggctttcagaaggggcttgggagttgggggcattttgctgcttctttgcttgcatgagtttttcagcaagatttttcttatgtttctcattggcttaaagaaatatttaattaatgcacaaaatcacaaatgtgaaattgtggagaataccaatttctaaataggaagcaataagtccgaacttc

SEQ ID NO: 762 - DNA, 500 bp, Homo sapiens
ctcattcttgacgtactcaaagtgggacaggcgggtgacgttgaggtcatctcggagccgcaggaagtactgttgcagctgcacctcggacagcagctccagcagccagcctgtgccctcctctggctgcattctgccgcctcccagcctctgtggggggaggagtggctcagggacaagggttgtggggggacaacaggggcctgcccgagtgacctgggctcaccttcatcccactacacggccacccggaagggctcacaccaccttctgactcccgagggaagctaccgagaaccgcctggacccacgtcccctattcctgccagccacagggcacaattagggcggcggagatacagccctggccctggagtcaggagtcagggtcttgctcccgaaatgtgatctgtgactgagtgacccaagatcaacctgtgctcacattcctgctctaagtttctaggggtcgaaagtccttgaaaatcttttaaaaacta

SEQ ID NO: 763 - DNA, 500 bp, Homo sapiens
tccagcagcccgactctgcagatctccttgctcctgacccagccgtccactcgtccccccgtgctctggcccccttcctcccggcagccctgacgcagcctttctgatttcagtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttttaactgttggtgtctaccgtgttctgtctaagatccgtcaggccaggtgcagtggc

SEQ ID NO: 764 - DNA, 500 bp, Homo sapiens
tctatggccccacactcctgcccccaaccctcctcccggctgggcccaagtctctctggaatccgtacacctccctccctccccccaccccttccccccacccctgccagctgatttcatttgcctgacgttgtggttggctctacccttccctgtcaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagtaagagggagctggcctgggctctgctctcctgggctggggcgcaggcagggctcaggcaggctggggctggacgcaaaggacctcaaacttggagggcctagctggggagagggtgcagccacccagtcgtttccctgtgtcttggagtctggtgtgggcacgaagggcagaag

SEQ ID NO: 765 - DNA, 500 bp, Homo sapiens
cctcccgagtagctgggactacaggcgcccgccactgcgcccggctaatttttttgtatttttagtagagacggggtttcaccatggtctcgatctcctgacctcgtgatccgcctgcctcggcctcccaaagtgctggcgtgagccaccgcgcccggcctcatttttttgtttttattatcagggagcaacggctccattctcccctaaggctgacatttttgttgaaggctgagcacgcatgtcttccgtgcttgtggcaaaaggccctttcctggctggctccagaatcctcaccagttaattgggaaaaaatttgagttaggcatcacaatttcagccgagctgggcaaacaacgagtacacctgtcactcgagccagtgtccaaaactcagccccatggatcacagctgtagcgttatttcagcatgagcaattcagtatttaatgttccttagaaaaaaagtaaatcattccaagctgctactgttcacctatt

SEQ ID NO: 766 - DNA, 500 bp, Homo sapiens
cacattaccttgaggaagctgcgttttaaaaataggaaaggaaacgatcgtcagtgtttgatgtcgtgccggaaaagcactcccatcagcgctttgtggcccagtgttttccacatcgtgtcgtcttttccttagtgaaatttcggcagattgttatgcagaagcggttctgtgtctctgtgtgactgggagacagctgttcatcctaatgaggatgccagcttcgcggcgtttccgctgatggagacccgcggagggagcggaatgttccagaccaggcagtggtgtgcggcgaggaggtgctgcactgtcagctggaggagcacgctcggctgccccacacgacaagataaatgagtttgccggagtttggcagcgtcggaaccatttccagtgcacggccgtgcgcgccagcctccccatgggacctgtgggctgagggtgccttggaaactgctgcctctttgccagttcttttttcttttgatgtccgacaatac

SEQ ID NO: 767 - DNA, 500 bp, Homo sapiens
caactataaattaaataaagtacattaaatttcacgtagtctgtaatttctatctcccccatgataggaaagctcttttatttcttttgtaaagtcaccagcagcaacatcaccacccagggtacattcagtaatctatttatggctctaaggatattctgtccccacatccctcccgcagaaggtgacagcagtttttaactcatcattttattaaagattcctgatgctacctctgcctaagacattcgcagcaagtgaaaatgttaggtcttggctaacatgagcattctttagttctcaggaaagtcagtctagaaatactggcaacaaccgcagccaggacaccgtgaagctctgtgtttattctgtttctctgggacggtggcagctgtgagtttcagatgccatctgccgaaggcaaatgcctagttaactgtgctattctcgatctcttcacagtccacagttctaccaacctctctctactttgcaatccc

SEQ ID NO: 768 - DNA, 500 bp, Homo sapiens
ggtacacctcctcgtagggcggcaccagccccccgagcggcgccgcgaagctgcctttgcatagctcggcctgctggctgcgctcgcgcttccgccatttggcgcgccggttcttgaaccacacctgcgggcacgggagaaaggcggtcagggcccggggccgggtcccagcggctgaagggcgggccaccccgacggggcttccagccggggccctgcggtcaataaacgagatgaggtggctagagacggggtgggagggaaggagcgcacggagtccggggtcggagaacagaaggcgcgggcggctggaccgagtcatcggcgccagggtctggcgggacagtaggatggggttgaggaggggtggtgaggggaaggagagacggtgtcagggccgaagaagcgcgcggtccgagtagtagggagcagtgggagcagaggctggaggttggcgggcaagagaccgcgtggggctgcggccgggagccagggtccgg

SEQ ID NO: 769 - DNA, 500 bp, Homo sapiens
cgccagggtttagcagcgcctggagcacctccctcttccctgctgtttccttaatgctggagctgggcacactccgatgtcccgcattctcacattcaatcattcattctccctctgaaagttctcaggctcctttgctcacgggtcgtctctggacctgagacacctgcgaaccttgcggatcaccagattgttttattgttcctctcttcccccactgaatcgtcggccgggctagtcttccagtttcgcctggagtcgattgcactctggcgcacgtggcctttcacttactccacatatacttattgagcttctactacgtgccattcagagtgctggcaccacagcaacgaaacagaccaaagtctttgccctggcagagctgatggtctagaaaatagcaaaaaaataatatagaaatgcaccctgccaggagattggttgtaagactgaggttcagctctggagaagcttgaaagaccaagggtggggtagtg

SEQ ID NO: 770 - DNA, 500 bp, Homo sapiens
gcattttgagagctagactttttccaagttttcttcttcccaaaggttaagcagagtcgacagagcactttctggggtcagcggtaattgctgtgtgaaggaggtaccagaagtgtaatttcaagaaggcaaaagtaggctcaactctcagctaaaataaactcttggaccccgcgagcagttaaagaacatctagagctgagtctcatttgtttttgagccggaggcttggtctccaagccctcccagcgtccacccgtctctctcctgccgggagttttctctcctaagagccggcagatgctggagggaagcgcttgctgcaagattccttctcccggtcccgtagattgcagagtccgcgggaccgttgaacggaggtactgccggctgagctgggtcttaagtgcccatgggttcataaactagctgtcacttgctataaacatgtacaaatggaggccacaaggatgtgggggtgctggggacctaaagctccg

SEQ ID NO: 771 - DNA, 500 bp, Homo sapiens
catgcaactaaacccacaacaagccgaaccaccaccacagtagctgaagtttctcaaaagggctggtggagagcaggaatttatattgctcaccgcatcttgggagcaggcgagggtcccccgatttccggggctgagttcccggctagacttgcgctgcagcctaggggagaaaacctctctccctaacgctgcgctgcagtcttctctaccttcccaagccgcctccaaccccaccttggagtctcccgagtcctcttcagtagcacacccaagggctccccgaaatctccaggcgcccccaccccttctccccgaaatgggggtgggattttatttatatttaagttcgcaaaattgaaatctttatcccgcaagcaagcgtgggtacttaattaaattctaattaggacactatcaatatcctatttagctgcgtagcttttgtgcgccgcggtccctttcagcgcggtaaatagggtctcgacgccttatctcgc

SEQ ID NO: 772 - DNA, 500 bp, Homo sapiens
ctgctgacctcaggacaccctgggctggtccaaggagacgcacctcccggggacacagaatcccacccccagtagccctgaccgtccagctcccgcgcctcccagccctaccgcatcccgcgtctgcagggcggggccgggccgttgggtcgcccctcctactctccactccttttctccctcggaaaccaccgagcacaaaggcagcattgattctccgccaccctcagagcggtctccggaaggctccgccaccacgcgctcgcctcacccctgcgcggagccaccaagagcaccgtgttccgaccctctgccctgggatccgagctagcgaccctctccgtcgcgcgcccggagtgctggcctcacctgtgggtcgcttttgggttctggcctcaggccctgaaactttcagagccagaggggagcagctttctctgcagcttgctcccccagcgcagtccttatgggaggagctggcaggggcctccgctgcctac

SEQ ID NO: 773 - DNA, 500 bp, Homo sapiens
taactgcagttcctcagggggtttataaatcaatcaatagggagtctatattcataaaggcctctgatctaattacaccccctccttttttccccctctctaaaaaagttaagtcgcggagccagggactcccagggtagctccgtccactaagggcggctggaggctggggagtcccggcgacggcggcgggggcatccgtggattaggatgtggattgcaggacagacctttgtttggtcacattcgcgacagggattgggggaagggtcgtcctccttcgagatcacgctggatttttatagactcgccttaaaagggctcactcttcacagggttaatttatacggctttcgaggaatattaggacttttaagacgctgtttatattgtcccattaatttttttgttacactcctaacccccacccctacaccccccggcttcagcatctaatagaaagggggtgggggtgagggaaaaagcagggcaaggaggcg

SEQ ID NO: 774 - DNA, 500 bp, Homo sapiens
taagttacctgtcatacagaatccaatcgaacgtaaaacattttctgttccagcccaagccaaactctcatttctcaccgtttgtttgttgttactgttgcagcttttcattttcattggccatctacttatgtacaacttaaacatttagtctcataggaagaattttttgttgttgttctcaaaatatatgcattcatggatgctgaagccattcggatttagcggccacactcctattcacgtgatcgatttctgcatattccactcgcctgaaccgccgcgcgctgactggttccgcctcaccgcccgggtgggttttattgctcagccctggggacttttaaatgacccttcagtaattattactcagtagaagcccctacgtcctggttccggtgctatcaacaatcaaatcaaaccccaaaataaacatacgatttcaagcattaattagaaaatctgcatgttttcaataaagctctagaaggtaagcacac

SEQ ID NO: 775 - DNA, 500 bp, Homo sapiens
agccagcacgtgtttgcaaacaacttaactgacttctcgaatattcatctgctgacgctggctttagggaaatttgaggggagactcgctgggcaaagacccgaggcctctggaggtttggctccccacacgcaggtcccgtccgcctcgctgattatcttttcttctttccagaggaagcggataggcttcagctttagaaaatttattgttttaatttgccagccgtaagtacggtcagaaagaagccggacaacaggcccacaagccgccccgcagacgcgcacgggaacaaacacgaacacgttgtgagccaggccagagaattatctttgtgcacgtggagaagaccttcatctggggctgctgctggtctattcctttccgtgcacttctactgacacacccgagcatcatgatacctaactcaactcgactttaggtttaaaaagaattaaaatcactaggtaatcacattacgagtcaaaggtcaataaaac

SEQ ID NO: 776 - DNA, 500 bp, Homo sapiens
tgactctataatgcatcgcctgaccaggaaaagtgtttgcttttgtgggagcaaaagacaactttctgccccgccagagcgttgctaagtgagcggtaatgaccacgctagaaatttcatagggagaggctaatggcaggctgactctaaaagtgcttttaagtgcaacttctgtctaatcccttgagggggaagaaaacatcggcgactaagaaagttcaagttgtacaggacccgggtttttggggtcggggtcacttctgctctgcgtgactttgaagaggaagacctgcggttttttccagtggattttcacacgtgttttaaagagaactcccggctcctgaaatgaaaggcccgcctgtagggttttgctgcctcccctctgcccacgccccacccccacagcctggatcaaagcgatcagacaaattattcagaagtaacacagccctgaaatgttcctaaacgtgactatttgaggcgatgaatcaagcgtg

SEQ ID NO: 777 - DNA, 500 bp, Homo sapiens
gtgtgtgttgtgtgtgtctgtgtgtttctgttttactcgctggagatactagagtgtgacaatttatatccaccaggcagtgtggcacatggaaaggggatagtcacaggtttttaaagccttttgaaagtagatgcatctctatttaatttggttcgacttattcccagactttggagctcagaaagggaaggcaggctggccactaagtccctggtctggcgctcagcggctgaaactgcagcgtttcggcctcacagatggggctggagttggagacgtcgctgcggccaggactgggaggccacttgcttggcgggtgaggcggctcacgcggtatttattgactggctcgggaaacgtgttcttttacttacttgtcattaaagttctaagttttaaaagcgcattcccagaaaatgcttttattctctttcccccagtaacagagcccgctaactgctttcaactggagaaggggagaaattcactcctgcacg

SEQ ID NO: 778 - DNA, 500 bp, Homo sapiens
cgagatcccgccagttacaacacgagttcggtccccaattgcggtggggcctcgcctccccagggccacctcggggccccagaggcctgtgcctttccggctcaggggccagaaggagctggaggcggtggtcaggggcccaagctcagaggcgggtagcggcctggaggtcggtgggggcgggggacgcggcctgggggcccagagtctcgcccgggcccggtaagggcagtgcgatttcgagtcccccggtttccctggcatttcctgtcccatagcttccagcgcaacagaggaacgaaaagcaagttttcctcggccctgcgcccacccagccacgatccgcaccatcctccagcgtttccttttctgacaccagttttctgcccttggaatgaattggattctacctgatgaggaaaaagaaaaagaaaagaaagagattttctttcctcgaggagggaaacaacattattttgactagattagattgtgcacct

SEQ ID NO: 779 - DNA, 500 bp, Homo sapiens
tgaggcgggaggatagcttgagcccaggaggtcgaggctgcagtgagccacgattgtgtcactgccctccagcctgggcgacagagtgagaccctgtctctaaagacaaaccacacacacatatacacacacacactgacacacacttattgttcaattcagtgcgtgttttgcttcgttttggatgaaaattaacaggctttcacattgtgacttaatcttatcagagactcctaaagtaaacaatagcgcagtaggagaaaccctgattgtgtaacttctgctcttgctcccctggaaataatgtcatttcctataaacccacccccaaacaatcgtgactacgtattcataccactggagtcttccaaaatagcaactgcacattatttatcaacgtttagtttgcatttgacaaagcacatccacctgggcttccatttatcattgctattattatattttattattattttcttatttccaaaatctttgtagaa

SEQ ID NO: 780 - DNA, 500 bp, Homo sapiens
gtaaatgcagggcggtagatgtttgtaaacacactgctgggctacccagtagttgtgtgtatgcatgtctatatatctgtaaagactgtggtgctgcggtttgttgcttctaaaaagttgttgtaaagtttgccaccattgggaggcaggatgatttatccatctacccgtgttatttttcccatcgctgcatttattgtacactttattcatttcgctgttccaccagtacccaggtagaaagccttccgctcttgtgagaggctgaagctgctgaagtttgtttttggtttggcctatttaatgtgtgttcactgaatggacactacagcaacaatgaacaaataacctgttttcttcgtctgtggggagttagaaaaacccttcctggtttaacactgcctttcaattagagtctgtgtaggggaaacgcagtagttcatcatacgtgcttactaggttttttataattagaatcacattttggtgtttcttatcag

SEQ ID NO: 781 - DNA, 500 bp, Homo sapiens
gtggctggtaagtacatgatgcagttgagttgatttacattacaagttgcaaatcagggtctgtgcattgagtttccctccggttgtgaaaggggtctaagcgctttgctggggcctggcaggcccctccctgggctgcaaggatccgcccctctattccccagataaattcctagtgtccaccaaattcctcagcgctcgctcaccctcctctacggccacgactctgggagtggggaaacagagagccggttcctctgctgcagaagtcctcggggttccttctcacaactctgcgaaggggaaagggttgtgagacccaaccagaccccaactccagctcccagcaggaggtggctgcgccacactcgggaggcctcttggtttcagggtctctctgtctctctctcaccctcttcctcgctttctctgtctctctgtctctctctctctctctccctcgtccactcccccaaacatgtccaccggctccctcagcg

SEQ ID NO: 782 - DNA, 500 bp, Homo sapiens
gttacaggggctcccagagtgggatggccggaatgtggagacgccactgcgttggagttaataacacagtgtcacaaaggaatttaagcctgaactctggaaattctcttttaggagcttatacttttccttcttcaaacttctctgttctgtctaaaaagaataaaaaccctctgttgtgtttcctgccggaggctattatcacttccttccaactgccccttgtgaaatagtcaaagcatccctgatcgcggaggagacaaccgccagatcacaaggtgagttttgtattccagagtttcaacggctctggatctgtttccaaaatgacccaccctttctaggggcgtgttgcctgctcttaggggctgtatttggcagacatgcaaatataaaacagcctcaccaaagtgcttactatggacacagcctcttggccaagcacggaaaaggttacaggggctggtgtaaggttggatgggaacgtgaatgagatccag

SEQ ID NO: 783 - DNA, 500 bp, Homo sapiens
gctccttcagtcagtcttcttcctcagctccttccgactccggaagctgctgtttgggcccaggctccctgcatccgagagccctgggctgactgcttctgaggccccgccccactactgcctgcagcgggcttccttactccgcctgctggttcctactggaggagaggccagcatgcttgtcaggcaccagcaggtggaggtgtggggagggagtcagtgggctaggttcgctgggattgcatctttcgtttcattaacctttatagaagtgcagggtggggctttcgctgatataggacatctctgaagactctagtttcctgtccatgggaaaaaagtctggttgcttcgcttgcatactggagcacaacttccttatacaccgcatgcagcgtccctggcagggcaaggtacacagtactccaggtagtgattcgattccttcatttcccttccccttatgagagtccaggaagaggcttgctcatcctcagctt

SEQ ID NO: 784 - DNA, 500 bp, Homo sapiens
ttttgctcccaaggttttaaaataaatcgagtttgcactttgcctgctcaaaccttgcaaaagtgcagaaaaataggagaaaaggtgaaggtaaatatatcaaatacttggaataaacccttttaaagtagaagtcaccgaagtgccaggatgggagaatcagggaagacgatgccactatgccctgcttagcattacaaactgctaagccatctcacctttcacctgtctcagtctctgtcttggggacgacactcttcatgagatttctcggaggacattttggtgtcttggggctggcaacacgagagcttggagggcctgctgtttcttggtcctgctgcagggggtccccatccaaataagctgaataagttatctcaggagaactaaggaaatccacacgtggtgacgatagtacttgataatggtgaatcataaaagtatatgtttactgagtgcttagtatgtaatggtattgttctcagtatgttacaaag

SEQ ID NO: 785 - DNA, 500 bp, Homo sapiens
ataaattgctgctttgcaagatcaaagtgccgatttctggtgcatctggaggagtggggagatggggaggaaagagagggggagagtggcgcagccgtggttgcccaacttcaaagggttctcaacagtgcattttgccattgtattttaacatctcttccccaccagtttggcagggtgcgcagcggagaagcgtgtagcttcagagttcagagcttgtggagaaaccttgctttgaccatctctgagcgcccccacgggactcagaaccctgaggctcttctagagacaccaacttgcggtggtggggtgggggtggggaggcgtggtgaggaagagtggggtgggggctgatctggatctgtagagtcaccaaatacaccaataaaccgcaaagaagccaccaagtagccatgcccctactcaagctcaaagctagaaggctagctgaaggctccttgtcaattttccctgcgctcaggctagctgttccaccggaa

SEQ ID NO: 786 - DNA, 500 bp, Homo sapiens
tatgttaaagttttgcccgggttcagcgtttgttctcaggaatttattatggcattcagactaaactgctggaaaaataaaaggaacgaagtcttggctaggagctgaagtgtccccagcaggatatgacgccaggagtgttgtaaagactgtctgtccttagagaaggtaccattgtgcatagccttttatttataacttggtaagtgccagcgaactcgcctcctttacacccccgagtgccagccccgcgctctgcactgcgctttattcgctcgagcctattcagggactgtcactccggggccgcgaggtattcagggccttaatcaatcaaaaggatgagaatcgggcaggtttttccctttgaaataaaggaaacaatgacttctgggcttcaagttcccccttttccttttatgatttttgaatttttcctgcccctggagggagttctccactcctctctctctgtccccctcccccacctcctttgacag

SEQ ID NO: 787 - DNA, 500 bp, Homo sapiens
ttattgggccatttccttaacgcgcggtctgtccccgtgggcagaaacatactgcgagatgcagtttgggtaattaacaaagagacgagacctaactgggcttccgaaatgctggatactgcggccgggtcgccccgcattcgggcatcgcgcggttcccggccttcgggacgttccggcccggccggactttgaccgctggcgtaattaggagaaacgcagaaggcggacgctccccaatttccccatcgagccttctcctcccgagtctgcgaagcccctggctcaggagacaccggctccgcgcctgggcctgcaaatccgcttccagcgagcgcaggccctgtcgctccgggctataaatattaataagctgcgcggctccgggcttaattatctccctttaattgcaactcaacaaaaaatccagtctcctgccactcagcccccctaggtcgggatcgtttggtttcggtgtcaggaggctccccgggctcaga

SEQ ID NO: 788 - DNA, 500 bp, Homo sapiens
cccaagcaactgcggccgtcgggcgcgggcgcgtagccctgggcacaggtgcagcggaaggagcccgggaggttctcgcaccagccaggcgagcaggggctgccctcggcgcactcgttcacgtctgcggcggaaagacctagcctcggactctgccccaccggaaggcggaccgcgcacctcgcgggggtgtgggtctcttccctggaacgcggggttgagagggcagcctctactcccggaaggccccgcccccagacgccaatcaccaccgctaccccgccccgcccccagcggagccagactgggggaggcacctgacggccccacccactcggctccgggccccgccctcaccgcgacaggccccgcccccctggctgcggtagccaggctgacaggcgatgcacttgaagctcccgggcttgttctcgcatttgccatccgggcaagagcttgggtcccggcactcgtcgatgtctgcacgggagggagaagga

SEQ ID NO: 789 - DNA, 500 bp, Homo sapiens
acaatgacatcctattaaatgtacttttaaaaatagcttattttcaatacacttcttgattttttttaaaccgaaggctgtattctactgaacagcctacttcaaggacaagcttgcaaaaaaaaaaaaaaaaaaaaaaagaatttgctatcaggatacctacttacaacaccctaagatgtcattattccacacaaattagcttattttcttgtgttttcctctaattatcaaaggctatataatccacgaaccctttccccaaatcaaaataactccagatcacctcaaggtaggaggtgtttaagaaaacaagccagaattagataaagtaaaacttactttattaaataggatggacaccacttctcccaagagaactgtctccaaaagtaaacaagaaagatcaatctggtaaactcacatcatacaggttcccgtgtaaggtatcgggttcaggcaggtggaagccaaatgatcgtaattaaagttaattaaca

SEQ ID NO: 790 - DNA, 500 bp, Homo sapiens
atgcgctgcaaacccgggtgaacagatgtgcatggtgccctcacccagccccggcatggcctagacaaccgctgctcagccctgcgcccgtgaaattacattattttctccccggcccaatcatcgttttacaggaaaaaaaaattaaataaatataaattgctgctttgcaagatcaaagtgccgatttctggtgcatctggaggagtggggagatggggaggaaagagagggggagagtggcgcagccgtggttgcccaacttcaaagggttctcaacagtgcattttgccattgtattttaacatctcttccccaccagtttggcagggtgcgcagcggagaagcgtgtagcttcagagttcagagcttgtggagaaaccttgctttgaccatctctgagcgcccccacgggactcagaaccctgaggctcttctagagacaccaacttgcggtggtggggtgggggtggggaggcgtggtgaggaagagtggggtg

SEQ ID NO: 791 - DNA, 500 bp, Homo sapiens
ccttgccggggcctcgcggaccggagaggggccggcgaccctgctggcttgaggcggcgtctagctggacccccgccgccccgggtccgagcggccccgcccagcacaaaggccagcgggaggaaggaggaagtgggcacggagcggggggagggggcagggcccattctcacacctctcaacgacttccccgcggcgggaagcggctccatttacaagtgtaaaggcgaggcgcgaggtgggggggcccgggggtgtcagataccgcggcccgcggaggggccagggtggggccgccaagtgccctgcggggggaagagggcacagctggggcggggccgcgccgccaggtgttctggcccgcgggggcggggcctccaggtccacccgccgggaggagaggggcgaaccccagggatggagggggcttcacctggggctcgggagccaggaaccccgggaccccgggaccccagaagcccggacgccaggaggcccgt

SEQ ID NO: 792 - DNA, 500 bp, Homo sapiens
tgcacgtgagcgtttgtgtgcatacgtgtgcctgtccatgtgtgcacacacttgtgcttgtgagtctctgtgtgcccatgcatatgtatgtgtgtctgcatgcacatgcgtgtgtgtgtgcatgcatgtatgtgtgcaggcatgcgtgtgtgtgtgtgtgcagtaaatggaagaggaacagagatcagagctgaggctggcagggctgaggcagccggtggctggtggacttccccaatcccagcctggcgggggactgggtgcccctagcctctactacagagcctgggggctgggcagcgggcaggcaggacagggcctggacctcgtccaggaaagagctaatgatcaaccggctgcggtgtctgtgcagccgccctgggcctgcctctccgtcaccggccctcaggcgcagggaggaagtagggcaggaagcagggggcggaggccgctgtgcagtcagcctggctgtgggcggcccctgcctgctccgtccagct

SEQ ID NO: 793 - DNA, 500 bp, Homo sapiens
cattgatgagccttgtcatcatccttcaagtgtaatttttttaaattgcaaaaatcttacagagctattaacctcaaaagagtttaacatatggcagaccgagtctccctcttaccctaattataaggcttgcagtaatggggctgtcttttaagttacagctgctgcgcttttggctttcgctaacattacatcctattaaagagctacattaaatgcatgcaaattgccggagcgacggcgctctcccgaccagtgagggggacggattgcagccgaggcggcgatatcggggtcagactcaccctgctgcgagcgccatatgatctatcaatcaaactcctctcattaattaactaattcattaaatatctttatatatgaaggcccggccaggcagaacattgtgttgacagggacgtcccgtcagcacttagccctgctctccccacccctcccctcctgcacaaatctcccggtgactaagagaggtcagcttc

SEQ ID NO: 794 - DNA, 500 bp, Homo sapiens
tcctcgcggcaggccaagagaactcagtttctgcttccagcgcaggccttagctaggaggagttgtgtgtgggtgtgtttttcccaacaaagagggatcaggagagagaaggggggaaagtagaggggaaccagggagggggcggggaggggaagagggcagtggagaggtgaaatgagcccatttcagggggagaaggaaaatgaaagcaaatggagtacggccttctccgcgcagggcgggtgctgacgagccgggagcgggctccctgcctgcggcagccgggatggcccgctggggacaccggagaaagcctgttttaaatttaatccgaacttgacggtgtggattgaaccggagggaatttaaatcactaaaaggaaggcgcggggcagggggaggggacgactctaacctgtctatctttctgtctgtccttcccacggtgctagtttggttgtggccgcagctgcccaggtttcaggtgatggagtaagggt

SEQ ID NO: 795 - DNA, 500 bp, Homo sapiens
ctggaatgggagtgggttggagctgggacaagaaaactccactccaggatgaaacgcgacatgcaaatcttcaccgggttaaacaaacagccgagcaagctgcagcttcagcggaggtggaggtgggggcggacgccgctcgcgccggtctctgtttccaaagttgttacagtgagaaaataagcggcttcgtgcagcgtgttgtatgggctgatgcctcccacccccatgccagcccacagcaaaacccggcagataatcagcacatcccactgtttagtcatatttgacaactgggttaacctggtatctaagcgctggcgaaaccgtacaaagggtgccctcaattaccaccagaagcctctagcgtgagtggcacttgtattaccccccgggtcagaggccagagcgacaattaggaagtcacttacaccgctggggggaaatggcgggatgcagcaggctccaggccctcccaacaaatctgtggatgtagatct

SEQ ID NO: 796 - DNA, 500 bp, Homo sapiens
tccacccactgagtccgcagctgcccccacccctccactattagagaagaaggtgaacggctttgagtttccctctccaaggcaggaggtggttttctctctgagcgtctcctcccctctctttaattcactttcccggactggagcctcagccttgacttttcctcctgcactccccaagcccccaccatcgcccccagcatctcttcgtcaaagacaaataaagcctagcctcctgcctgggttgaccggttctccggtggaggggaagagagagagagagagtgagaacgaacgagaacgctggcgaagaggaatgcgctgcaaacccgggtgaacagatgtgcatggtgccctcacccagccccggcatggcctagacaaccgctgctcagccctgcgcccgtgaaattacattattttctccccggcccaatcatcgttttacaggaaaaaaaaattaaataaatataaattgctgctttgcaagatcaaagtgc

SEQ ID NO: 797 - DNA, 500 bp, Homo sapiens
cgctggctttagggaaatttgaggggagactcgctgggcaaagacccgaggcctctggaggtttggctccccacacgcaggtcccgtccgcctcgctgattatcttttcttctttccagaggaagcggataggcttcagctttagaaaatttattgttttaatttgccagccgtaagtacggtcagaaagaagccggacaacaggcccacaagccgccccgcagacgcgcacgggaacaaacacgaacacgttgtgagccaggccagagaattatctttgtgcacgtggagaagaccttcatctggggctgctgctggtctattcctttccgtgcacttctactgacacacccgagcatcatgatacctaactcaactcgactttaggtttaaaaagaattaaaatcactaggtaatcacattacgagtcaaaggtcaataaaaccctcaacagtttaaaataagctttgccctcaaactagaagtcacctagtctttct

SEQ ID NO: 798 - DNA, 500 bp, Homo sapiens; identical to SEQ ID NO: 278

SEQ ID NO: 799 - DNA, 500 bp, Homo sapiens; identical to SEQ ID NO: 197

SEQ ID NO: 800 - DNA, 500 bp, Homo sapiens
acaagtgcccattcgcgtgggttttgtttaccggaaattaaatgaaaatgatttagtccgcgtcaaacaaaaatatatacttgtatacacaagaaaaaaggtctgttagacgtaaatattatgtccttaatgaaaagcctggacgggctccaggcttggcctttcaggatttcagtgcgacttgcacattgccatagaaatcctaacttaccatgaagatgcaccgtggcgaagaaacactgctttgtgcgcgggccctttgatgtagcaggcgcgagatgcggggcgctcagctgcgcggagcgagattaccttgcgagcaacgcggtggacatctgtaacaagcaaatgaaaaattaaaggcgattagtggccgaccaaacattttgttttatttcattattttagattgagatagaaagcaaaatggggagcttagaaacagaagacaaagaaaaaagtcctacttcaggaagggggactttttaaacattggcaga

SEQ ID NO: 801 - DNA, 500 bp, Homo sapiens; identical to SEQ ID NO: 32

SEQ ID NO: 802 - DNA, 500 bp, Homo sapiens
tcgctccacccggaaaaagcgctgtccctacaccaaataccagacgcttgagctggagaaagaattcctcttcaacatgtacctcacccgggaccggcgctacgaggtggccaggattctcaacctaacagagagacaggtcaaaatctggtttcagaaccgtaggatgaaaatgaaaaagatgagcaaggagaaatgccccaaaggagactgacccggcgcggtgctggcgggagcgctcaagggcagcggatttgttgttgttgctgttttcctttgtgggtgtttggtgcttgatttccagaaactctccagcgacttggacttcttcttctttttttttttctttttagatagaagtgactgtgtggttggtctctgaggtatttgggggactctgtatttgctcgtttacgtgttggaaaaaccaagtggctttggggtttcgccctatcccactccctctctttcctgctccattggttccttaagaaatgcta

SEQ ID NO: 803 - DNA, 500 bp, Homo sapiens
ggagagagggcatggagtgtaggtggaaggcccagaaagagccaaacgatctagtcgtttttctaaagttctcagtaacaaccagttgtgacgtcttaagagagaaagaaggccttttacagatggacagaacatgctgcttctcggccccggccacagttgggagaaggtggctggtaagtacatgatgcagttgagttgatttacattacaagttgcaaatcagggtctgtgcattgagtttccctccggttgtgaaaggggtctaagcgctttgctggggcctggcaggcccctccctgggctgcaaggatccgcccctctattccccagataaattcctagtgtccaccaaattcctcagcgctcgctcaccctcctctacggccacgactctgggagtggggaaacagagagccggttcctctgctgcagaagtcctcggggttccttctcacaactctgcgaaggggaaagggttgtgagacccaaccagaccc

SEQ ID NO: 804 - DNA, 500 bp, Homo sapiens
cctgccacaggtgagctagggttttatgacagccgtggctgcagtgagtctcctcgacctctcgccagctgttacccagcaaagcaccttggggagggtggggctgcccacttccggggagggggggagggggaggggagaaggaagttgatctaaacccgcctctttctctgtctcccttcctgccctattcccctcctgccccttccctcccaccttgcttctggtgtgctgtcctggaattgcacgcgcttcctgaccaccaggctctggcccttgagaagccagcggggctttgtccctgttgctctccttgccaaacccagtctctctgctagtggtggtttcggttgcgacaccgtccaggttcccaggcaggaaccgctcggcctggctgcttagctacttttcactgaggaggtggtggaaggtgtcgcctgctctggctgagtaagggtggctggctgagccggcagcccccgccctaggcctggctcttc

SEQ ID NO: 805 - DNA, 500 bp, Homo sapiens
tgttaagatttcttgttgttgttttcgcgaggcccgggagaatcagctctcccaccttgcggcaagaaaagatgacttgtcaggcctctgaaacgccgaattctctgccggactgcggaggggcccagggaaatctagtctttattattacagttggaagtgttctggtgctgaaggcaaccacagtgttgtgaattcaccttgggcctctttggacaagaggctacttttgcccccttccttcacccccgccccaaattaggatccaaccaggatgtcaggaagctagcatcccaggcgaatgcaaaaagaacaatggaaaagccaccggatgagtgtgattcagccaagcctgacctccccggagcctgtgtctcaggcttggaggtccccagggagcacgaacatgaactctggggagctggaagcagggtactggtccccgcctcctgcagctctgcccagaggacttggggagcccggatggagaggcgcaggat

SEQ ID NO: 806 - DNA, 500 bp, Homo sapiens
aaaagtgcagcaggtttcttaggtgtcacagagcttaattcagtgtggcaattgttccttactgcatttgttaagttgcccataccgcctggggaaacccgcacacgttttcagatccctccaggtgaactcctccaccctgtccccgcccccgcccccacccccaaccaaaacaagcattcgttgtgggtggggactgcgactcctcccagattcagagctactgctctgggagggccgtcaggaacccgtatttatagaagacatggtaggtgccaaacgtgcttatgagataaacgacagggtaactgtccacattggtcccagtttatgagggagaagagatcataatctacaaaaatttgcaaggtgaccaggggaaaagagtgtaaggtcattttagcccacctgggtcttcacagaaaatggagcacatttcagagccaaagtaaaaaatttgcgttgtcctttgctaagagagagatgaaaagtgacaatac

SEQ ID NO: 807 - DNA, 500 bp, Homo sapiens
ccggaagctgctgtttgggcccaggctccctgcatccgagagccctgggctgactgcttctgaggccccgccccactactgcctgcagcgggcttccttactccgcctgctggttcctactggaggagaggccagcatgcttgtcaggcaccagcaggtggaggtgtggggagggagtcagtgggctaggttcgctgggattgcatctttcgtttcattaacctttatagaagtgcagggtggggctttcgctgatataggacatctctgaagactctagtttcctgtccatgggaaaaaagtctggttgcttcgcttgcatactggagcacaacttccttatacaccgcatgcagcgtccctggcagggcaaggtacacagtactccaggtagtgattcgattccttcatttcccttccccttatgagagtccaggaagaggcttgctcatcctcagctttttgtgggtttggaccagttctgcccaaatcaaagtatg

SEQ ID NO: 808 - DNA, 500 bp, Homo sapiens
gacagtctcctctccctcttgcccttttgctgagcctaccctccctacctccccacctcaccagcccaatttccttccccagctcccaagcttctgagttagcagcctcctgtttattaagctgtaaagttaggacggttctcatttctgatcttttctttggctacacctgacttcgtctctttttttcttttttccccccacctccctaaactaaatcacttgcgcggttcttgccttttaacggagcgataacgtgaggacatctgaaattccgactttattttcctccagcacacctggcccctgccctccaacgggaactcccgactgcttgcttattttagctctcaattggtattaaaagcagactgtagttgggaccatctgatctgtaaacgatgcaagccctagacagcttttcccagtccggggtagggacgggcggccgcgagctggggcagaggacctgcgggagcccgcgcagcgcctccgctctg

SEQ ID NO: 809 - DNA, 500 bp, Homo sapiens
gacagagctgtgagcctccgcctgctgagaggagggcacttgggcggacctgaagttaagaggcccggggtgaaggccagagctcaatctgcagggatagaaggcgcgggaaatccagcaaaggatggaagaacagtccctgccaggccgcggcctcctcgcccccgcctgcccggcctcacccttctggaagttcctccaggcctgggtgggggccgccagggaaggcgcagagggagggcaagttggcgccgctagttttagagaaatcctaagtaaacagtgaacccgagcaggaaacctcagctttgcctgggtaagagaactggccacacagctccaagaaaggagaggaggagaacaaatctctgcgccctgaggatggtggctttattgcggaaagaggtggtggggccggagctgctctgcaacttcctctcgccccctcaaaaaaaaaaaaagtatcccgcagcgaggatttcagaaggggctcacctggt

SEQ ID NO: 810 - DNA, 500 bp, Homo sapiens
ccaataaaaatacaggatgcccagttaaattttttgaatttcaggtagataacaattttttactctaagaatgccccatgcaatatttggcaaccctatttttaacatcacatagactatataaatatgaagctgaatcttagcagattctctcctagtttggggctggggaagtggttaggtgtggagctaatatttactctttttccgcccgtaattttctttcttccgttctccttccgcaaggaacgtcttggggcttctcgaacatctctcagcatttactgtacgcccccctcccctcgcttttgctgataaaatggttggtgttgtgtttaaagtgtttataaagtctcctccgtgataacgcgagcgtttaagagagagaattctaggcacacctcttcctcccctccagagtgccccggcgtctttctagcctccgcctccaggcgggtgaggaggtgacacctgagaattcctccctctcacccctgacc

SEQ ID NO: 811 - DNA, 500 bp, Homo sapiens
tggtgcgggacatgaatgagttgtcgcaacacaatagcgtgcagccttcctacggggactggatgaccagcggttttgttgggagtgaatgcgaggagatttctgctacaagtgccgcgttattatgagctacaaggtcagactatacatcgcaggtccccaaagcctatggaccttgggaaatgtggggcctcgagtcacgtcattgtacctgacagtctttttcaatagactaattcaattagtgctcgcggtttcggtcttcatctggagcccataataatgtgggggtgggtgggtgctggggattcgtttgggtattggttagggatcctaagcaattctgtccaaagtggagtgggactaggggaggcagcaaaggaaaaaaaccggtggccggggggtgcatggggggcaaaccattgaaaataaaacgctctgctgacaaaataaaatgctccgttgactcctgaaattggggcagtagctttgtttgtaga

SEQ ID NO: 812 - DNA, 500 bp, Homo sapiens
cttttcattccttaccgaagcgtttactgccgccgtggtcgcagtcataaattttgctacaaaccacaatgacaggtgcattgatatgcaccgtgagagctccagctgcttaataaccccgtcccctggtcgctgtgagcgccttttatttatttggtatcatattaggtattgatctctagtagcattaagtgcggtgagcaagtatcagggttcggctgctttggaggcgcagcggttgcggcgggccggcgggcccggggaagcgggcggtggccgctcagagaataccttccttccggcaggagaccgtttggccctgtattccgggcctgcggttgggcctccaagctgagttgggcaacttcccagcaccgcaagaaagggcgagccagacctatttggcacccctttcccaggaggagcaggggatggcgccggcggagtttggggaggctgccctggccagttccccgggctagagggtggaggagaggagg

SEQ ID NO: 813 - DNA, 500 bp, Homo sapiens
acctgaaatccataggagtccaggtggtgaaggcttcagcactccatcttggggtgcctaggtggcaagtgagctaggcagggtcagggaggggacatttacttctctgcctcggctaggcgctccagcttgtagcgctccgcttccgctggcttccgcacccgggcctccagctccttctcccgccgggcgatctcctgctcctgcactgccacctgctgggcccgctccaccacctgcacctgcacccgctgctcctcaatctgctgcttagtcttggccacctgggtaggagggtgaagtcaggttcacgctctgagtcagaggtgaagagcaagtgcccgggaaccagagctccagagtgggatataaaaataggagccggtggccgggcgcggtggctcacgcctgtaatcctagcgctttgggaggccaaggagggtggattgcctgagttcaggagctcgagaccagcctggccaacatggtgaaaccctgtc

SEQ ID NO: 814 - DNA, 500 bp, Homo sapiens
ggagaggagagtctcctggagccgcttcgcggatcccactgggtcacctggtcctggcttattttctttgaggcccattctcggggagtaaatagacagtagcgagtttcctggcaactttgcactactctttaaatagaagagaattcctccagtttgcctccccttataggctttcccgcctcaaattgttttaaatgctcctcacagtctttttgccccttctcccaatgacaaggcaagtctcagcgggtgaccttggtgtgtgccgcagggttcaggctcttggagcccagctgccctgctgagagagcgggaggatagtcgcacctaattagtacgcggctccggcggagatgagtgcgtgggcactgtgcgtgcatcttgcacatgacacccaagttcaaagcgccctgcttatgaaaacttggggcatcaatatcgtctcatcactcaggcgcccttagcgaatctggacagatcgaggggcgcagtcttgg

SEQ ID NO: 815 - DNA, 500 bp, Homo sapiens
tctctccccacccaagttctgctgcctctgtcaccccagcgagtttcttcttctttcccgtttatttttgtgtttgtattttttatttctattttggaagagctaaaataaacgcgagaagaagtccctgcagcccgagtgggagaccccggggcgacgggaagcctggggaaaggaggatgggggagaggccagtgcgggctgcagaaggctgtttctctgctcgctcccgtttctgccttttttcaccggcactccaagaaaattgggtgtcctaagagccactccgctccgttccaccccatccccagcttgccagggtcgtgggctggggcagtagcgagcattcttttcttccagcttgcagctccgacccgggcgcctcttcattcgcctccttccctcttgttgctgtgagatacctccattggctttcagaatgatttcagcgagcaggggctggctgcgcgtggtggttgttttgggattatgtgtgcgtg

SEQ ID NO: 816 - DNA, 500 bp, Homo sapiens
tttccacagccgcagtgtaggaaggggactcctgcctcccagggggagacgtgtgtgcggggtagaggggagtccccagcgcgcggcgagtaaacaggggtccaaagtggttggaggagagcgcaggagcggaggctgcggtgggagccactttcccccgcccctccacaaatcgcacctgggcggagcgagggagtggggggagccctgtgctgcgcccgggaggctggggagcgcagagctggagggcgtgcagggaaacgcagagctaggaggtgtgggcctcgggtgaggggagacccagctcttagacctgggagcccagacagaggtggatctgcccaccttgcagctcccaggtagattcttcttgtggctccagatgctctggcgaatgcaggagggggaggctcttttctcctttgcaccccagcaatctggagtgcaagaccgtttgcgggagggggcttagtcggctgtttcgaagaggcagcctcccc

SEQ ID NO: 817 - DNA, 500 bp, Homo sapiens
cacaaacctggtgcagagctcttctgctttccttttaaaaatttattcatactcaagttctttatacttcctcgtttcactgtttgaagaaaatcggaagaaatttggttttgaaaaaagtcgttggtccccacgtttccaagagatccggaggtttcagcgcaatagttttcagttaaggtgtcatttgaggccctctatatcgcagcacgttaaatgactcgcgtccagctccccatttcctagcctcgggcctacagggctgggggcgacctctgcctcccgtccccagagcttacaaaattccttccagttgtattttagggcttgttttcctagagaaggttgagactagaggaaggattaaagtggtgggggaaggggcaagaccgaggggtccctaccccacgcggctttggaggatggcctcccagggttagcactcgaatgctagagcttcttgtccacactctaccaggtcagtgtcccgcgatccccac

SEQ ID NO: 818 - DNA, 500 bp, Homo sapiens
gcatcctcccacagaaaggagataagggccttatccaattggctgtacacaatagatcagtgcttctttcctagacaaggctgaaaggggccaacattatttctgaagacttcattattggaattctatgggagtgatctcactgagctattttggaatagaaatgtggctagttgcctgacctccctcaatggtttcacgtggctttcaaagggaaggaagggcagtgctgacttttggtaaaatgggcgaaagggtccatgccagcaacacaatcactcaaagtccagatgagggatcagtaaatacaacgtgcctgaaaggtggcccttgagcacattcctccggtagacattaacttattaaattgattctgattacaaatataaactttgcccccatctcacccagtaacaatgcaagagttgatgtcagtctataaaaggaagtaggaactgtccctggctttcaggctccaacatcctccccctgtcaagatg

SEQ ID NO: 819 - DNA, 500 bp, Homo sapiens
tacacatctttgtaaccttagcacccagcaccacgcctcgcataagctgggcactcattcatgactggctaaataacaaatggatggactgatggacagatgaaataactgttcattgaaagttttatttcattttaagtgcaaccctcataatagtctttaactgctggcttcaaataacagaatatcccaatagtctaaagtatattctatcataatctacctgactgctacagttcaggagagacacggtaacctctgtcttatcatttgaccttctcactctggagacagacataagttgatacccattaatttccggtggaatgagtaggtcatgagggattccagagcctcacagagcttaccaggatggcagccatccaaatggagcagcaaacaacttccagtaatttggtctcacctgaagctaaacaaagctacccagaaaacacgccctcataacacagaaatcccagaatgaaagacaggctttctcc

SEQ ID NO: 820 - DNA, 500 bp, Homo sapiens
taaggttcttaattcattcaataagggttaacttttagtagcctgtgaagttttggcaatttgacttacgatacaataatggtttagcccattattgtttctcgccagatagaattaaattgggggaatgaaagaatgctccagtgtggcgtagtttttaaggtaagggaaagacttttacacaaagtttccttttcagatattattgatcacccttttgttatcaacacacagagtaatcctatctgtcggttgacaaccttcagtgatttttagtagaaagtggtggagagaagacctgggattcaatcccaacacttaacagctaactaacctcgggcaagtgactatctctaagcctgtttgttcatcagcctaatgcatatacagcaatctacattgccaagctcacagaattcttgagagatctaatgagataatatgtaaaataagctttaaattttataaaacattagttttaacaaacatttcctatgtga

SEQ ID NO: 821 - DNA, 500 bp, Homo sapiens
tcctctaatccttgtttaataatataggtaatgtttaaagatatattcttgaaattaattaacatccccaggcttgctttgatattcacataagaagctgtccgtacccttagaaacttggtctcatgctgttttcaaagcagttgtggaaataattgttgctttcaaaaaaaaaaaaaccacaaccccatgaggtgttttgggtctggcaataattgattgtcaaagaagttttcaagataataaaagcgtgagataattcagggacattggccaaagtatgtaaagtccatgatctggatgataaggggctaactgaaagaaaaattcttccagattataagaagaaactcaggggaattaaagtatggctctaacagatgacttggctgaaattagaaacttttttttttacatatatctttatctactcctggagggaataaaaatagccaaactccggccgggcacggtggctcacgcctataatcccaacagtt

SEQ ID NO: 822 - DNA, 500 bp, Homo sapiens
gtcagttggtgggacaatcaacagcttcctggcagcagaggtggtaaagaggcaaggaaggagtgccagaaaggggcgttgccccagggtaacagcgcagaagtgcagggggtggaaaaggggtgggatgggagcccactggtagaaattactccctctgtcaatgattaactcccagccaaaggggtgacctgggaggagggcccagctaataggaactttggacttgaggcagagtatccagagggccggcatgtggtctgcagaagaggaggacgtggctgggtggcagggctggtctccaaggacgagtaagatcctgcagctgcaggcttcaggaagtctcctggggctatcagatggctccttcttgtagcagcagctgtggggtccactggccctgagccctcagaggggcggccgtgggggacctcctgtcttttgccttgcaagggcctcagttgtgctttttccctctaggcagccatgggtgccaggca

SEQ ID NO: 823 - DNA, 500 bp, Homo sapiens
ccaaagtaaacagaggcatctggcggggatagagctgcattagggcccattgccactttttttttttccctttaaattaatgtggcagaactcctcctgtggccaacttacaaagacctgttctaaatgggaaaattctgtattttaaaataggcatgcttgaaacaataacacttttgaatgtaagatatatgaaaggccacacgtcttcggctttgcttgtcaaatggagaggctgccagaaccggtcggctccatggttctcatgccccaaagtcctgcaaattgacacgtaagtaggcaacacacaaagaagttcagcccatgagaaagtgagtttgggcgcttgggctggcctcctttctctctgtgtggagttctttccaactttgcctcttctgtcccatcttagtttttcagaaaggagagattaaatgtgtctggtatatcagcatgttaactgcttgggcaacatgaggctagcactcaggacactgttc

SEQ ID NO: 824 - DNA, 500 bp, Homo sapiens
tgatggagggctgaggagaggcctcaggttgttatttggttggggaggcacagagcagaggttcaggtctcagcaggtgtcagaggtgattacagcccttcccatccaccttgcagcaggggctttgtgcctttcatctttaactgggcacctgagatgggaaccaatggggaccatcccagacacatgggtttgtctgtccctgacttctgcctctgagattgtctttgttggtctttgtttaataaacgccccgaccttcctcatgattgctcacaggagtccctgcgtttgtcttcatcccttctcaaacatttactcgacataaggccgcgtgacctctattctgtttgtccagcttatgacctttggacacattcacccagcacaggatatttccaggcctggttagtcagtggcggtttaatgtttttctgacaggaacctctgggcactcaaaattcaagtaccttctaattctaatgaagatcggacctata

SEQ ID NO: 825 - DNA, 500 bp, Homo sapiens; identical to SEQ ID NO: 551

SEQ ID NO: 826 - DNA, 500 bp, Homo sapiens
gagcccctatggccgagccacctcttaaaggcccaccttttactaccatcccactggcaacatggaggaacacattcgaaccaaagcagtgctttttaaacatcaccccagaaaggacctaaaaatccaggaaacaaggaaaaaaaactcactccagattgtccatggctaatgactttgggcccaaaagctgtattcccaggaatgatttactaagggacaggagttttattattaacccacagcaaccgcgtaggaaaggaaggcacttcctggagaatggagcgtgctgtgtatctactcacgtgttacagttctccactcggatcgttcaccttttcaaagaaagatgggcttacagtaaggttgcttaataaccttagaaaacttgctcataatcacaagcagtttacacttcaaatcactgtagtataattaggccccagacggaaaggtgctgctgttgctgctgcaagaaaagccctccttcctaatctcat

SEQ ID NO: 827 - DNA, 500 bp, Homo sapiens
aggacacagctcacacctttaacgggaaatgtccccatcactggggacagcagggagctgatgggagagcaggtgtccaggacatccagagaaatgtttcctcacactggaacccttttctattcccttctaaacaaaaagaatcctcgaagactctcaagtgaccatatagtgtcttttcttataatgtcacttcgacaggcacaaaatgtaaaaccaggcataaactactagtgcttgcagttcttacgcaggcatgaagccaaaaccagtttacaaattaaccaccaagaaaaccggtagagcacagatgatgacgatagagctgttttgtccaatgtgagcgctactggccacccagggccatgtgaatttaaattacgatgaaacacaatgaaaaatttggttccttgtggccacatttccagtacccagtagtcatctgtgccagggggttatccaggtacagaacattcccatcgttgcagaaggttctatca

SEQ ID NO: 828 - DNA, 500 bp, Homo sapiens; identical to SEQ ID NO: 638

SEQ ID NO: 829 - DNA, 500 bp, Homo sapiens; identical to SEQ ID NO: 629

SEQ ID NO: 830 - DNA, 500 bp, Homo sapiens; identical to SEQ ID NO: 347

SEQ ID NO: 831 - DNA, 500 bp, Homo sapiens
agagaaagagcaggaaggaagtccacctcggcggctccgggcacctgctccaggcccagtgttttcatggtgttgtgtctgatcctggcgactcctgtcagtgaagtcctagagcccagtgtttcaagcaaggatggcggaacacagagctgccaaggacactgcaaggtcacatgtcatgtggttgacagcctacgctggggggccttggcctgaagcctggacctcaaccctcccctccacggcatgcgtattgctatttaatgaactagacttgttgtcaacaaaggcgggactctctctctctcacacacacgcacgcatgcgcgcgcgcacacacacacacacacacacacactcacccacacacgcacacacacacacagcctccagtgattggactatgagcaggaatcaggaggctttcaagatctcaagccagggctgacagaaacgtgggaaggagagtgaggctgctggggggctagggagtcggcgtg

SEQ ID NO: 832 - DNA, 500 bp, Homo sapiens
aaggaagaaatcttcaagttaagttgtggctgcagtggctttgcagtgaagtcacccgactcattctcaataattcaaatgaattgagaatccccttagaagtgacagcccaaagtgtaagaatgataaacggctttggccttgataatttttattaagcactaaatgtcacatttaacctgcattactgaaagcaattacccgtgtatcaacagtcaagcggctcggcgcgcagtgccggcagaagcgcgttcggctccatctgggaataaggattttcaattaggaggcaaatggctgcagaggggctcgggtcctccccagctcccagaggaggcctgcggagtgaagtcttcatacacaagtaatcgcagccgtgtcaacagaccgtccccagccatctgctgccagagcagccgtactttatcaaatctcaatatttacagacgctgatcagctcgtggggccgggatggctccctgccagggagttctgggaaa

SEQ ID NO: 833 - DNA, 500 bp, Homo sapiens; identical to SEQ ID NO: 649

SEQ ID NO: 834 - DNA, 500 bp, Homo sapiens
ccttgataatttttattaagcactaaatgtcacatttaacctgcattactgaaagcaattacccgtgtatcaacagtcaagcggctcggcgcgcagtgccggcagaagcgcgttcggctccatctgggaataaggattttcaattaggaggcaaatggctgcagaggggctcgggtcctccccagctcccagaggaggcctgcggagtgaagtcttcatacacaagtaatcgcagccgtgtcaacagaccgtccccagccatctgctgccagagcagccgtactttatcaaatctcaatatttacagacgctgatcagctcgtggggccgggatggctccctgccagggagttctgggaaattcattttaaggtgtgtttcagtaggctaattaatttacaagcacctgtttcatcgctgcgagctgttagtgccgcagatgagccccagccggggagggagactgtatcccggctaaattgatttcaattgattttaat

SEQ ID NO: 835 - DNA, 500 bp, Homo sapiens
gaatgataaacggctttggccttgataatttttattaagcactaaatgtcacatttaacctgcattactgaaagcaattacccgtgtatcaacagtcaagcggctcggcgcgcagtgccggcagaagcgcgttcggctccatctgggaataaggattttcaattaggaggcaaatggctgcagaggggctcgggtcctccccagctcccagaggaggcctgcggagtgaagtcttcatacacaagtaatcgcagccgtgtcaacagaccgtccccagccatctgctgccagagcagccgtactttatcaaatctcaatatttacagacgctgatcagctcgtggggccgggatggctccctgccagggagttctgggaaattcattttaaggtgtgtttcagtaggctaattaatttacaagcacctgtttcatcgctgcgagctgttagtgccgcagatgagccccagccggggagggagactgtatcccggctaaatt

SEQ ID NO: 836 - DNA, 500 bp, Homo sapiens; identical to SEQ ID NO: 42

SEQ ID NO: 837 - DNA, 500 bp, Homo sapiens; identical to SEQ ID NO: 48

SEQ ID NO: 838 - DNA, 500 bp, Homo sapiens; identical to SEQ ID NO: 693

SEQ ID NO: 839 - DNA, 500 bp, Homo sapiens; identical to SEQ ID NO: 728

SEQ ID NO: 840 - DNA, 500 bp, Homo sapiens
ccccgccagcagtgccctcggctggacacacctgcgttgtgggcagccggcagcgcgtgacccactgtgcacctgcgccttgatgtaggggggagaccctgcagagagcgcttccttccgccctgtccagtgccctccctgcctcacccctcttcccgcaggcccgctcagggcgctgaagggctcctgaccgtgggtccgtccttcgctgcgtctggggggcgtcccccgcgctgcctctgacccgcccggccctgcgtttgtctgaagcccctcgttccgcatctccggaccagggtccgggggcgtggtctgctgggggcgggcccgggttgtggtttgagagccgctcggcctgtctgggcctccgcctccgggtcgccctccagccttcctgccgccgcttttccagtcttgcccaacccggtatttctgcgcttgcctcagccacccgcaggagcgcaggccgcccttcgtcctcccgtcctctgcgcccacag

SEQ ID NO: 841 - DNA, 500 bp, Homo sapiens; identical to SEQ ID NO: 723

SEQ ID NO: 842 - DNA, 500 bp, Homo sapiens; identical to SEQ ID NO: 727

SEQ ID NO: 843 - DNA, 500 bp, Homo sapiens; identical to SEQ ID NO: 736

SEQ ID NO: 844 - DNA, 500 bp, Homo sapiens; identical to SEQ ID NO: 491

SEQ ID NO: 845 - DNA, 500 bp, Homo sapiens; identical to SEQ ID NO: 495

SEQ ID NO: 846 - DNA, 500 bp, Homo sapiens; identical to SEQ ID NO: 483

SEQ ID NO: 847 - DNA, 500 bp, Homo sapiens
gcagacattttggcttctgcagctttgaagttctttttttttttttcctctgaagttaaaagaatgaaactgggagaggtagtaaggggcaagaaaggagagtggaaatggagagaaaagggcagctctgagaagcagctggggagggaggcagatgagaatgcaccccccccaacagaacatgcagtcttggcccagctgtgctgtgagtgggcagctgggctggcccctcctctggtgctgccaacccgctgccaggcagaggggaggcccagaggagagggaagctgggcaaaggggatggaaggcgtccagcccgaccttaccaaaccccttgggcctcgtgggaaggggcctcttggagagggggactgaggctctagacaggatattcactgctgtggcaaggcctgtagagagtttcgaagttaggaggactcaagacggtccctccctggacttttctgaaggtagaaccagcctcataagtaactaggctg

SEQ ID NO: 848 - DNA, 500 bp, Homo sapiens
tttattagggctctgttatgtccttcatctgaaatgtacacatttttggtgtatgcttggtactggagattcatatatgcaaatattctcatgcaagaagttccacagtaacaacagcaaaaagaaaaaattagttgtccagccagtgctggaggaaaatgtttctggggaagatgactcagtcattttgtggcgagacaccctttggtaactcccactgaccagtcttgggagccttcctggaatgatcgtgggctgagcggagatgttttttgcaaaatgaaactgaagctgaaagaaaggagaattcgagtgaaccaagagaaatccaaagacctggggaaggaggacttaagatgaaagtgaagcaagagagggaaggggaaatgaagtgaaaatggcgtgagggtgtgagagaggtttgggttaggaaacatgtttttagtgctatttccaaccaggggtcgcaaactcagcagcctgtagaaacaggggtggga

SEQ ID NO: 849 - DNA, 500 bp, Homo sapiens
atgctctcttatctctagtttgcttttttgtgtacaaactgttaacctgaacagttttccggtgcaaaaggtctcaccagaaactttaggaaagatgagtgtgactgcgggaagcagaagaaactaagctgagaaaacccggaaaaatactcggcgcagctgctgcggccttgggtcatctcacctccatctaccccgcgtgctcgctttcgcttggggtggaaagcggggttcaggggctcttttcagcggactgagaaatcgcagaggccgtgggtaaggattcaagcttgaggaaacactgggggccgggaggagggctattgtaaagcatttcttaattaatttcaagtcctccatttttttacagggaccccaagtcaggattcccctttcccgacatcaggggtaaagggagcgggggtcccttcgcttcactgtgccccagctctaccgagaggcaggcctctgggaaacgagccggggacctgggggcccgg

SEQ ID NO: 850 - DNA, 500 bp, Homo sapiens; identical to SEQ ID NO: 267

SEQ ID NO: 851 - DNA, 500 bp, Homo sapiens
tcccgccgaacgagaaagcgcggaccccttgcaagcagcatatagcctcggcgtgacccgtggagaggcgggaccccagtggagagagaagcacggagaagcctgggaaggagcttggtaagaggggcacagtccaggctgccccatgcgcgctggggttgtcgccgcgcctcctgcgcgccccagtgcccccagaatctccaagaaagcaatcgtgagcgcggatcagtttctgtctttcccagaaagcgggctttttattgaggggaaacttagctgggaaaagtcagctcgtacgtttgttttggtttttcgtctatttgcttcccaatttaaaagtggccgcctaggcgacaggcctgcggttttcacagtgtaaaacggatcagagggaaagctccagcccctctcgactttcgcttgcggtttgcaacccctggggtgggtctgaccccgcgcggcacttgcccaggcgagcttccctcgtcgcggcccgaccc

SEQ ID NO: 852 - DNA, 500 bp, Homo sapiens; identical to SEQ ID NO: 498

SEQ ID NO: 853 - DNA, 500 bp, Homo sapiens
ggcgccatcagcagctgtagctttggctcggaggtgccttctgtgaaatggagcaagtgagggagtgggcagctcccagcccagcctcgctcctgggggctggggggctgtgttcctgctcttacctcagcagcacgaaaagctctgtctagatgcattctcctcactggccccaggcagatgcgctctgctcagctgcctagctgctggactgcccccgcacagatcagggaagttcccagagcagcacgtgagacctgttttatgggatgttaccacacacagcttaagacacgttgatccagttcactcctagtttctaggcaagacggtactcaaactgtcccagaaagagagtcatctactattttgttaaaaatatccaaataaggaaatcctacaacctctctggtgtctcatatccctactttgtaacctaaatcttttctgatacgattgaaggtctctcttgggctattctcagaggaaataacaggagc

SEQ ID NO: 854 - DNA, 500 bp, Homo sapiens
ctctcccccatccttcctcacagagcagcgcaggtttggccacagatgtcaggagcccgcggcttccctgctgagctaagagccctcttcaggccttgtggtgtcactatagctgacagtgtcaagtctcacgccctttacgaagcagagaggggttttgatgccgcattgtttagcagtatgcagacctctccctaggggctgtagatttcctgccttctgaacaatctcgaggggagcgtggatttccgtcccggcggcaccctcgggttttccctcccctgccccctccgccgcgctctcccccttcgcacattcggaaaccctcttgggagctgaatcatgttctcgccttttttggtcctagttgagctctcttccactttcatcaccagaggcttgagatctgtgaaagaatcagttcctcgcaggctgcggtctgcgccgcgcctcctttgtatgtcacgctcagagaggagcagtgcccttggagtgccctg

SEQ ID NO: 855 - DNA, 500 bp, Homo sapiens; identical to SEQ ID NO: 266

SEQ ID NO: 856 - DNA, 500 bp, Homo sapiens; identical to SEQ ID NO: 497

SEQ ID NO: 857 - DNA, 500 bp, Homo sapiens
ggccaccgagaagtcacgttccccctcctccctaccccattccgagatatgccctagttccaactggagaccactgcccactcccatccctccttaagcaggcaccttgatacccagcttcaccccctcatcactcaggtccgcccctggtctctggggccctgccactaggcctctccccatccggataccccagccgcgtcctctagcctcacaggacccgcctgcacctcttctggtttcttccctcgtggctcgggctcacccctggctcgtcaaacctcgcccgttgtccccgagaccccttcctggctgatcagcctgcaatctggtctcccgaagttgcccccggttccctggttttccgacccagccctactcctagatctctggagctctgccccatggctgcagggcacctcgcggttagcgatgtggcacagcatctcctgcacgtcgtggccctggagctgcgcctgcagtttcagcagcttttcctc

SEQ ID NO: 858 - DNA, 500 bp, Homo sapiens; identical to SEQ ID NO: 485

SEQ ID NO: 859 - DNA, 500 bp, Homo sapiens
gcaagagattctgagaatttcattttcaccataatggctcagcgtttgttcctctaacaacgtgcagttaacagctgtgcgctggctcttacattcaaagccaaaaagcaagttcttcacattaaagaaatcgttaaagacagttcaaggaaagagaattaggtattttagagtggctacgaaaagttttccagggggcaaaaagcactaacctgtattgttttaatctgctgaaaacaaccaacttctcgagttcccctgctgtcttctagccagtttcctgtaaatgttgcatgtgacattatacttcctcactgcaccttctttgactcgcctccctaaccggtcagaggcatgtgataagatcaatttgctgcttgcttcacatgggggtaaccctgtgtctgcagaaatgattgtctcccccagcttctttcaggtgttcccaggacacaggtaaagaggagataagccagggggaagtcatgcctggactccag

SEQ ID NO: 860 - DNA, 500 bp, Homo sapiens
gccccctggggccgcccctttggcgcccgctagtgcgggaggggctatgctcccggaggtacgtggcgcccctgccaccctgagagctattttctattcccaggtggtcgcgttatcctcatcccccgccctgcaccttcgtcatcagctttgcctctcccgtgtccgtgtgtagctccatcctcgtgctcgccttcttcattggcggaagctgggagccgagagagtgagccgtgcgcagatgtgcggcggtggaggtggcttttgtttctcctccgcgccccctccccccccgccccgcacattgcctgtcgctcttcccacctaggaccctcaaactggttccccctgtacacagaacctggcgaccacggatcatcccctctctcttccttcgatgcgatcatataacatttagattttgccaggcccctttaaatcattgcttctttgaaccctcccaacaatcctaaagggaaatactgtttatgaacccgttt

SEQ ID NO: 861 - DNA, 500 bp, Homo sapiens
ctcaaagttttgtggtgaaattataaactccagaaaaactgaatttataatggaaatgctgacagacctttcagtggagcagtttgaacgcaacactgtaatttggcaatctctcttacagactaaagactaattctaacaagatgtcattttgactcacgtttattattacctgcaagaatgaaaaacgccgtttactcgggaggtgcccgagaaccagggtggggcgatctcacattttaagcaagacgcccgctgccttaccaaaatagccctctccgccaaaggaggggcagcctttcacgctcagcttctttcatgtcagcccgagcctttgcagcaagacgtgcctttcctacatgttacattttaatgatctgagaaaaccgttatcagcgttaacatctctaattttactctaaacagacaaaagcaaaatatctcattaggcatcatctccgccaaggttcccactaggcaggaaaggatttttatctaaa

SEQ ID NO: 862 - DNA, 500 bp, Homo sapiens
acctcatcaggggctcccccagagttttctgtgcgctgccgtgtgtctgggccagcgctgggggcaagcgatgccttctgtggtttgaggtcttgtaggcaggaggaggaggaggaagagggcacctgctgagatacttcactggtctgagggccccttctgccccagctagcgcttgggtgagggttgggcttgcggagccgtcctgtaaagccggggatggcaggacgcattgtcaccccctcctgccgctcttacgaaacactcttaattgagtccgattcttggtgaatcagccttccaagaaccgcgaccgcagcatcctgtgccgcttctgtgttccgcatttttctctttctgcagcgtttcctctcattctggatggaaaggcctgtttgtctccctcaatctttggcgagggtggcaggcagccaggcggccattacgggccgcgcctcccaccagccagtcgctggcaggagcgtccggggagggagcag

SEQ ID NO: 863 - DNA, 500 bp, Homo sapiens
cactcattgtaggaattgctggaaggggctggtggagcaggtctggttgcgggagtggggtggtggcagtgggcggggccggcggtgatgggcggggcctgtgggtgggggcagggcctgtggtggagggcggggcctgtgggtgggggcagggcctgtggtggagggcggggccggtggggaggggtctgtgtgtggacggggctggggcgggacggggcggtgcagggagctgggcggatcaggccccggcccactgtgcacgccccccaggcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgc

SEQ ID NO: 864 - DNA, 500 bp, Homo sapiens
ataacagactcacactgttgcccttcttagtctcttgctgggcaagtacaggggctgacgggtgtctctcctgtctcagccttggtgggcagctcttctcggtacctggggggcccccaccctcgccccggtcctccgaagctgtccccagggtctggacgggagcactcacagacaagccgaagagctggttgaaggaagggagggacacgtgccggtcctccatcttgcggcgagtgttccggatggcgtggatggagaccagccactgccgctgtgaggcccgggcagccaatggcacctgcttctgccactggccggcgacttcccaaaggcggttaaagaaactctgtgccaggctttgggcatccagcactgatgggcacaatggagggattgtcagggaagtgccaaccaagccagctgaggcctcgctggctccctgacagctcccacaggggcctgcaaagcccccatcacctcccggggcattgtgagca

SEQ ID NO: 865 - DNA, 500 bp, Homo sapiens
ctccaccctgggtttgtggggagatctgtgccctcctctggggtggttttcagattgcccaggatcagagtaagcatacgcggttctgaaggtttgtggacagtgacacagtcgtgcatagccagagcgcatcaggaagccgtgtttatcacagtgcagagcgtcttgcctgatggagtgttctgggaatgctggaggctgggggcaggcggtgcccggtggcacgggcgccctggggcggtgttggtacgaagggacacgtgagtgtaatggtctttcagaaaccacggctggcctggctttggtttcactgctgagctcccacccacagcagcccatccttgccccctcggtcctgggctggtggggtcatcctcttgctctcactgccgaccgcgttcctctgcctgctcacagcgcctccttggtgccctcagtggcaggcttgctggaaagactcatcagaggttaattaaatccatctccacagcaatgggagg

SEQ ID NO: 866 - DNA, 500 bp, Homo sapiens
cagcaagagaaggagcaggagaggctggaatattctggcttgaaaacagcagctgtgtaataaagccgggctggtttgtctcagggccccgctgtcccttctccccgcctcaaagtagcagcatgaatcagttcactgcggcaatggtccaggcgatgtgacttgcatccccatcagctacctgattgcggtccctggatgcatgaggcgctggatgtgcctggcataccaaactgcccgcctctgtgccgcagctactggtaatgaagatcaccggccccgcccagcactgcggacagagccgggcattcttcaaggccaccactggtcttttatcttgtccaaggctctgggatagtcaccgaaatccttgggctgcttttgacgggggccaccagcctgtctcaaagatgccctgacaagcccctccagccctgggcagacaaaggcttgaaaggagaggaattgcacacggtccagacgctgctgtttctaatacg

SEQ ID NO: 867 - DNA, 500 bp, Homo sapiens
ccgatcctttctccatccccccaaacctcccctggctctcgagaacaccgtcagtactccctaataccccgtgctccaaatccggagctcggtctccacccggccgcactccaagtgacagcaataatagctggtgtttctaaagtgcttactggtaccaggggctgcatccgtgtagactcatttaatcctcacagccctaagagagacacgtttgacagatggagaaactgctccgggatactccgtcggggaatggcaggagctggccccacagcccggcctggcgccaccgcgcactgcctgggccctgcagcttggagcaggccctgagtgggctccctgcaaatattctcatgctcccttctcaccaccgccctgcaaggggcatggtactgagctcaccgttttacaggtgaggaagccacggctcagccttccgagtctcctctacctgagcctcagagcctggctcagaggctctgtgcccagaacgacag

SEQ ID NO: 868 - DNA, 500 bp, Homo sapiens
accgtgtaccgcctgtctcggggtcgttcgctcaccaaggcgcagcgtgacgtcatcgaggactgcctcatgtcgctctgcaggtggagcggggcaggcttcagggtggggcaggggcaggggcaggggcaggggcaggggcaggggcaggggcaggggcagggggaggagcaggggcaggggcagcagagcgggcctggacgggggattctacatcttgtgcattgtcccgcaggtacatccgcccgtcgatgctgcagcacctgttgcgccgcctggtgttcgacgtgcccatcctcaacgagttcgccaagatgccactcaaggtgagggcaagcgctctttagcatctcatttccaggccgcacccactggtttgctcttccctcctactgcggggctcatttgtgtcggcactgcccagcccaataaacctgcactagttagggcagcgtccccgtagaaatctcttagcatccttatttgcatactaggattcc

SEQ ID NO: 869 - DNA, 500 bp, Homo sapiens
gcagcagccctggggaaacggctcagcctcgagctccttctgagctagggacgcggcaggagcggctgtcagaaatgggcccaggtggcctccaggagccggcccgatccacgatcagttccatcccttcttcactggcacatctctgaggcagctcctggggaagtgcagggcccccgcgagggctcgcaggaagagcacgggacagaccaaacaggcgctaccaagtatgggttccagacccccacccggccattccagacgcctccctgtgctgcgcacacagcctccccgcacccgctctgcagctcagagctgctcaccctcagctctgggtcctccgcacccacttcggattcccatcagaggacaggccctgcctgtgggcccatcaccatcccatctcccacctagacggaaaacccgagctctgctcctcctgaaatgaggccagccctctggtgtcaattacatgcaacttccccgggcctcggcttctt

SEQ ID NO: 870 - DNA, 500 bp, Homo sapiens
caacagcccttggtgtctacttcttatcctagacacacagtatttcaggtggccacgcgtgatgctgctccttccgtgttaacatctgctgcatgtgggctctgtgctttctccctccctgagaattcagtgtgtgcaagaggcttcctcttccacattctttgattcttttctcgcatcctgtgcaagtcggcaccttctttccagggcatgcgacgtgatcattttcacgaatgcagcgtgttttcccggcactgcctgtgcgcatcgcgttctccagccaaatcaaaacatgctccgggcccagggtcctgatttgcgctttgtacccgcatccctagcaacatgcaaggcgcacagcaggagcccgacgagtatttttgattaatggggcttcagccatgaaagacagccctctttggggagtgctatccgttaagtgggtcaattagcttgtctgcgcccctcatgactgatgggatattgtgaattactcatgt

SEQ ID NO: 871 - DNA, 500 bp, Homo sapiens
ccttgaccccaccatggggtccctggggcaccctgtcagggtggtatctcccccggtgtggggtcgccacccaaccagccacttgggctgctggcgtgtggccactacaggtggctccggcagccccctgacctcactactcatggccatgatttgacatgggtgggcaggtggcactcggcctcggcccctcacggtgccaccagggccgcactcaccacacattcccgctcttggtctggtccacgacgagcaggttgctatgcacctcgtccaccagctctggcgcgatccagcgcagaggcacccacagctggtcggcagtcacgaagtagtcctcctgttggcacagggacgggtcacccctgccggcgcaggccctgcccctcatgcccagcccagcccaccccaccccactcactctgtacttgcagtgagccaggccatagtcaccaatcttcaccgtcaggtcagccgtgagcaggcagttccgcagggcc

SEQ ID NO: 872 - DNA, 500 bp, Homo sapiens
tcggccgtaacattccatcacaagggcccacagccacagtgtgtgggggcctgtcatgtgagggggctgtcacctgagggggctgtgccgctggctcagctctgcctgctggccggggccctactccctctcagagatgacacacaagtgcccccaaagaagaacccgaggagtcgcaggctgggccaggctgctggcttccagtgacatcacatgactttggggccactgcctcatcccgtatctgcgcgtatgagatgcattgtctcttcctctgcagttgagctgaatgaatacctccgaagccgctttgttctccagatgtgaatagctccactataccagcctcgtcttccttccgggggacaacgtgggtcagggcacagagagatatttaatgtcaccctcttggggctttcatgggactccctctgccacattttttggaggttgggaaagttgctagaggcttcagaactccagcctaatggatcccaaac

SEQ ID NO: 873 - DNA, 500 bp, Homo sapiens
agaggaaatattgaatggagacagctcttgaaacaaatatgtcagttcctaatgcagggatctcatccgtgactgtgctccctgggcccattgtaattcacgccgagtgcgcccttagtcatctttggcagtcattggggattgggtcacaatttcaccaaacataatatcggctttctctaaaagagagtagtgcagcgtgggccaatggattctttgttgttcttcccctccagagtggagggtctccgctcagcccatctgcggtttctcacagtgatagtacttcatccacgcagtcgctgtctcatggaggggcgccagagctgttggtggggctctcgtacaatgccacaacggggcgattatctgtggaaatgatcaaaggcagccatttccgaaacctcgctgttaaccgagcacctggtaagtgtgagtctgttctcccagctctggttcttccagaggcaagtggaaagccctgtctgctttcatcttag

SEQ ID NO: 874 - DNA, 500 bp, Homo sapiens
tttctaggtgaacttctgaatggtcttcctgttttgaaagaggaacggagaagaagaaaaacagggtggtgttttgattatttaacaaaatatataatggatacatatattgtaaaggatgaggcaatgccacgtcgacttctatcggctctactccaataagcaggcaacgctccctcagcagttgctagctttgctgcgggctttccctgttcccctgcaccagtgcgaaaagcagagtgtgccaagcggctggcgtctgtaccctgtgggaaaagttaactgtaattcttcggcttttaaaatcaattaacccgagtgttaattaacgtcaagtcgacgggaggaggagaagaagaaggggagggagggagaaaagaaaaaagctgcaagggcggatggcagaagagttggcaccgtgccatccattcaggggcaacgccacagtttcgtgtgatagcagcagcgggtatatgatacggggccctgtatgcgggcca

SEQ ID NO: 875 - DNA, 500 bp, Homo sapiens
gtcttggcactgccatctgctctgagcgagcaggcttttgtgagaagctgtgggagggtaagcctggctgattggctggagccgtgcccagagtgcccagatgtacatttgccccaaaagagggggcacagctggggttcactgtctccctggagggctggtttttctggtgcagctcaaggctgcctccctctttcctgccgcgcattctgctcagctgggcggcgaggagctggcccagagcggcaccgcgagctccctcaccgccgtctgcctgccatttgctgccactggggacctgcgactgcttccatggaaacagaaccatggattgtttttccagaaaacgtctcaatctaatttgtgtagagtcgcgttgcgtgtgtgcacgtctgtgtgtgtgcttcagtcacagaagggggtgagaagtgggaagaggggatttgcatagaacctccaattttccttatttcctagggagttgatgatttcaggtgagt

SEQ ID NO: 876 - DNA, 500 bp, Homo sapiens
ctctgtacatgctgctgaaggagcacacggtgtggagcatggaacacctcaaccgctacatcagtgacacgttctggaaggcccggggcctcgccaaggactgggtcttcaccaccctcaaggtgcgtccactgtgccctccagtctgggagtgagatccctcggggcgggggtgtgtggtcaggctgggcaccaggcacacagatgtccgtggcgtgcgtgggcggctgcgctgaagtgtgacctgaccgtgtggaaccaaacccttccagcgtctctgctcacttagctggcagtgcctgtccccagcagccagcaaaggcccggacggaaagcccagtcgggggtctgtcggcacgagtcccgcgggcagcctcgccgtagggtcaggggacagctcggcttcagtgacagccaccatgtgaagagtctttgttcctttcagatcctccacttggcaggcagggccaacagcagcccccgggccaggtgtcctggag

SEQ ID NO: 877 - DNA, 500 bp, Homo sapiens
gcccaacttcaaacacacggccttgctgcggacagctgaggaacagcagcagcggcggcagcggcagtagcaacaaacaggccgcctgggcccagctttaggagggagggagggagggactccccactgtgcagggcagcccgctggcagcgttggacaatgcccagtccacagcagctgcaaccgccggccaaaagcgatctgcacatgcgatccgactgacctcagctcagtcagagtaagggacatcgatctctaaggtcccaccagattgtatctgtaacgggcgtacaggcgatgttgctatgttctggttctacctacctccattagaatgttttccgaatctgctaaggaccaccgataggaccccagctatggagctgtcagcgtaaatatagaggctggttacatgggctcctcaaactctcccaccgtataaccctgcttgattcattcctgtttctttccccgacgccagtgtctccaggaggagtggg

SEQ ID NO: 878 - DNA, 500 bp, Homo sapiens
aaaagcagagtgtgccaagcggctggcgtctgtaccctgtgggaaaagttaactgtaattcttcggcttttaaaatcaattaacccgagtgttaattaacgtcaagtcgacgggaggaggagaagaagaaggggagggagggagaaaagaaaaaagctgcaagggcggatggcagaagagttggcaccgtgccatccattcaggggcaacgccacagtttcgtgtgatagcagcagcgggtatatgatacggggccctgtatgcgggccagacagtgcggtaaagccaagggagattatccagacccccaggagcgaacagcaagcagcaaccgaaggcgcaagtgccaggattacagcctaggctgctccaactatgagcccttcctcggaccctgggactcggctacttggggtttgggggtcttccacaccacagaggcacaaagctgactttaatcactttttttcctttaaacttgattctgccgcagtggagcc

SEQ ID NO: 879 - DNA, 500 bp, Homo sapiens
gaaagctgcccatgggtaaaaggaacacaaaacacaatgagagagtgatcgttctcagagtgacactggggcctctgcgggaaagctaggcaacacagtgcagatgaaagaaaggcagaaaaaacattttggccagagcagatgcgaaaccgttagagtgaaaagaacaggctcgctcttgactcgctggggcagatctcgccgcagggcagcaggcggtgctggtccagatactctggggagtctgcgcggtgtgcccggagcccctgggcgaacacggggcacgttgctgagaagcagtattttgtgtctctcattcattcccagttaatctcttaagttttcttcagcaacagaacttatttgtaatgccatgtgctctattgtctcttggggataaataattaatttctactaggctacaccttggctttaaaataattcgtgaaaatctcaagggaagtcatcaatttagagaggaaatcaaaattgggaaactt

SEQ ID NO: 880 - DNA, 500 bp, Homo sapiens
ccctttttccctgcagacatccagtccctccctctcatgtcccagtccttctggagtcttcggctcaatgagggaaagaatggccttttcttcccatttatacagagcgacaagcatcctctctcaggaagagccctcccatctggggcattaatcctcctttttttcttttctcagtgccagaactgaaagagcagattcaggcgtggatgagagagaaacagaacagcgatcactaaaccgttccgccgcccaccctctgctagacacagccaaggccaacgaggcaagcagaagcagcggccgcagcgaagctgccgttcatgtgttggaggccaaatgtggcaaaccaaccccaggcccacccagagcgagcaaacgctgagacctgaaaggacatggatgagaagaggagcccgcttcctgtacatatatttaagtgacaaacacggtcaaaagcttaagggacaggttttatggttgcttgtgtaataaagcat

SEQ ID NO: 881 - DNA, 500 bp, Homo sapiens
caggctgaggaattggccaccactgttctaaagacaagcaggcatgacaagatgggcgttaggcctgttgccgccaggttttgccggctgccgtccttcccaaggctttcccttctccatccatcctcccccggtccctcgacacagcactagagtgagaacaccctggatgtgacttggggactcctcctcggtgtgcttgcgtggagagtggagaggtgcgtcgtttgtgccccgctttgccatgaccggggtggtcctggcacgccgggtatctagacagcttttcatcagtcgctcatcagcatgctaattgccgtatgactaattatgccctgaattccagttgattttcttaatgagacagctgggttaattatgtaatcgtatgattacattagcctagagtgccctggcgaaaagtagcgtctgccgcattgtgatgtcatcgcggggacggtgctcacaagggggacattcatcctcaggctggtggcagg

SEQ ID NO: 882 - DNA, 500 bp, Homo sapiens
gtatgtggtgcttattaaagttacatacatctcttctcacaggagaaatttgatttattgcaggttgtgcatatgtcgcatatggacatttctagggaacagattccttattgctgagcagtgaatggcttctagtactccattattgctccgggaacatgttagtaataattatgaaaggtaggataccatgaaatctgtaaggtgatttggcagaagtcgatgctgttggtgccaggatttgggtaccgtaccacggtttcctgttttcaaatgtattaattgatccgcaaaggacatcttttggagacaagaattcagacagactggcacagcctggacctccgccaagactgctcggaaggttgccatactgggagcaaaagagtgagagagagaaagagggagagagagaggcagagggagagctgaggaaagaaaaaaaggcaagacttggcacagctcagtcaaatcagcttcttttgtctgctttctcggct

SEQ ID NO: 883 - DNA, 500 bp, Homo sapiens
gggaccaacaacgactcttgcaatcaatctagctgttttgcaaagtgcctgctgccacatcagctaggcacagattccttgtttgtgataatcagaatgccattctatttagcagtttccagttctcgattaaaagggcttttgtatcgtgtaacagagcctatgcttaggatattgtaagaaggaaacaaaacacacaaagccctgttcaacaacaaattgcaaaaaagccagtttgaaatcatcaggcgcgctggagggaaggcagggaaagcacatcattagaacatccttttgggaactgggtaccaattcaatgcagcatgtatttaactcactccacaaaaatggaataagtgcccttctaggtcctggggttagagcgatgagtaaacagacacggtccctgtaagagcccactgaaagccacctctgtgttgggtgcaggtgactaacttagaaccatgccaaccatgggccctgccccttaaggactcagg

SEQ ID NO: 884 - DNA, 500 bp, Homo sapiens
tggggcttggctgtggcctggaatagcgcagacatctgcaagttggaacccatcgagtgggggagagtgggcccagctgcaacgctgaactctcgtcttttaggcttgtgaatcacggctttattcctcattctggcttcatcaaatggttcatctcagggaaaagggacctcaacatggcttttcttttccttcggacggtttcgtgttgccaactctgctgcacatagtacaggaacggaatccaggcgcgcacacctggctttaccagaacgcacgttctgttcatcaagtgagaggctggcacatcagcgaggctttggtttgatgtttttgaattagaattgatgacagaaaaatactatgtgcatcacatcttattaaggaagatgaatgaggatctttgaaacccacacggaaccaagcttgggagtcaacctctgctggaaggaaggaagtgattccttcttaagaatgaacacataaacagaaacctgggt

SEQ ID NO: 885 - DNA, 500 bp, Homo sapiens
aatgggatgtgcctatatgtagatgtcagtattttcttctacgctctcccacgggggcagaggggaatggagtacaaatgttatcagcagccatctctatcatagtgtggtattacatttcatttgtaacaaatttaaatatgatttagtaagtattcatactctaactgccttggtcaatcagcaactttgaattataacaacgctgtgtgtcattaatccactctgttaactgcagaaatacaaaagcgtccttaaagcgtcccattataatgggcagacagcctggagaagaaacggcaggcgagcagggagagtgtgaccatgtaacgcgcagagctccacagtgagcgctggtgagccactcggagccctcacagtgggggacaagggtctcctggcctggggcatttcactgactgtcgctctccccttcttccacactctgtgctgactgaaaaggccctgacatggagacgccatctgtgcagggcattcta

SEQ ID NO: 886 - DNA, 500 bp, Homo sapiens
tcacattcagttaaaaacatcctgcccttctccctacaaaaaggttccatagaatcagaacgcagaggcgctgcaacttgctaactttgctctgtgttatttaccaaccgcacaaagaaaatgctgtctattcagaactcatttcaaaactcttttcactgagagtgagcgaacaagcgggctcatgtcccgagcccagtcacatctccagcggtccggtgatggccgtggggctggcgccgagtggcacggcctccacagtggcccacaagggtctgttgtccacgccgcgtggaccgcgcaggccggtgggagtcaagaaagggggaggggcgggggatcttccactttctcaccccgagtttctttgcttgcttgccccgagtatctgtcaagaggcagccctctcccctcaaggccccttcatcctgaacgtgcatgatgcccctgcagtgacaaatacagaatcttctcagtgggcctggatttgaggccgagct

SEQ ID NO: 887 - DNA, 500 bp, Homo sapiens
gagttcagactcacattctattaaaatttagccctaaaatgacaagccttcttaaagccttatttttcaaaagcgccccccccattcttgttcagattaagagttgccaaaataccttctgaactacactgcattgttgtgccgagaacaccgagcactgaactttgcaaagaccttcgtctttgagaagacggtagcttctgcagttaggaggtgcagacacttgctctcctatgtagttctcagatgcgtaaagcagaacagcctcccgaatgaagcgttgccattgaactcaccagtgagttagcagcacgtgttcccgacataacattgtactgtaatggagtgagcgtagcagctcagctctttggatcagtctttgtgatttcatagcgagttttctgaccagcttttgcggagattttgaacagaactgctatttcctctaatgaagaattctgtttagctgtgggtgtgccgggtggggtgtgtgtgatcaa

SEQ ID NO: 888 - DNA, 500 bp, Homo sapiens
gtctcattttcccagaaatgaagtctggtcgtgggctccttaccagtgatagtattgtagtggtaggaggcatgtgtaaaagcctggagaaggtaagccttattcttgaatctgtagttgattttcttttcaaaattttcaaaccccgatataaggtgattcagtgttttatctgcatctggatgatcaaacatacatcttggtggaatcttcaaacaaccatattccgagtctttcaatacagaagagcgtgaactggccacagaagcagcagcacagctcactgaaaggttcttttgttggctgttgaaattctcccgagtagggcacagggccttttcccgatcagtccttttaattaccgggagcaccttcagccccagtgaacagaggaaaagctgagcagccctctccccacagctggttaaatagcagcccagcagggcttccacacagtccgctatgcttttgtcagcaatacactgctcagtgtgcaagtc

SEQ ID NO: 889 - DNA, 500 bp, Homo sapiens
aaaatactttccctcttgtttccctcttgtcccaaaaccatcactatatactggaataggagtgagctgttcacttaaagcctgttatcaataggtttgtcaatggcctattaggtggcctggtataaaagtacagcccaagaagatgtctgtatcaaatggggactgcctcacccaatgatattcacttcaggttttgtggagattttgtgtctgtgcgtgcttcagtggggaaagacaggaagagagcgagagagaatcagcagagcagaggagagagaatacataacaaacagtgtcttcattcttagaggatataaaggctactttctacagttactgctgcatcactggagtctctgacagacactagaactggagtgagtcctattgtgtactcagttctttctgagacctgatatgcaattcttgagacatcttatgttacttgcttatggatcctcacaaataaacaaattatttacatatgaaataactga

SEQ ID NO: 890 - DNA, 500 bp, Homo sapiens
tctctgcctcaccttttaaaggacttgcagcttccactttattcctctgcgaatgctcactcttaagatgctccctctccaaactagccacaatagagtgagatgtccaatctacatggactggtcatgagtggacactccagtcaacagttccagctgagctctcagctgccagccaacgtcagctgccagccatagtaagtgacccatgttggacattccagggtggttcggttggcagcaattgatcgccaaaacagaaatgaagactcattgatttgaggtcccacggctagaaagtatctgtggtaatgctaagccagatgctctgactctaagcccacttgggctttgattcctcactgccttctattaaaaacagaacaagtctcgattcaaaatctccaagtgtagaatttctgccaaggatgcaggttgaggaagtgaagcatgtaatttggtcatttattcagctttgttcatttatgccaggcaactga

SEQ ID NO: 891 - DNA, 500 bp, Homo sapiens
ttccagttctatgttccttaccaaaaaaagggtgggggcagggatgttttgctccatgattcaaagtactgaatggtggagtttagcattggtacattcgcttctcctcgaagggtctcattcatcactaagaggtgtgtctggtacattaaaccttattgtagtgattgccagtgtcataggaacactgagctctctgcatgtcctgagcactctgcagcctttgaaatgaacagtgagggttttcatcgcagcctctcatttccaactgaaccacactatcaagaagagctactcagccagacaacatggggtctcagcctgtcacccagtgagggcagcttttcctcctagtgacagatttgcccttgcaatgtgaatccattcttccagaaaaaagtactgctttcaaggacacagaatagtgtcttaagcatttgggacagtagctcccccacctcctgggtaagggaagtcccaaagaaaagcactatgcaaaa

SEQ ID NO: 892 - DNA, 500 bp, Homo sapiens
cataccttgtgacaatagtgcacagcagagacgatctgccggaagaagtgccgggtctccctctcactgaggcgtcgccgctcactgatgtaatcgtacagctcccctttgctggcatattccatgatgatcacaatcttatctttgttctcaaacactgcagagggaaaacagcaatacacaaacaccccgtttagccaacaagctcacttatgctacagagaatgcgagagaggacaacggagatgtcgccaggcagaggatcgactgatgggtcagaacacaaatcagccaattcagcatcacgaggcgtggggcgtgctgtcccgccaggtggaaaatggtgtgtgtcaccaccactgttcctggacacgcctttgtcatgctaagggaaatgtggttcccttttctgaggaccccactttccttgtcaagatcatttctcataccctctcccagaacggctttcctgtagacaggatgatgggtaacaacaaaca

SEQ ID NO: 893 - DNA, 500 bp, Homo sapiens
gcaaatgccatttccttccaaattccttgctatttcccctcttgtttctccccgtcctttctctgtcattcttgctttctcttctcttatcctcccccactttggttcattagtggctgcctcatgcgctctggggccatttgcatccacaaaggcatcagggctggcaccctgccttccagctgggggtggtgccaagagcttcgagaacagtgctcagagtctttgccacactcagctcttccccaccgcttcatccaaggcaatgccgccaaaggtcatttcagtatgaagtctgattgaggtcctggggtgagaaaatagctgttgctctaaagatcagtactagtccaatggagagttcaagcaagtccctgcaggaaatgctggtaccagaactggggttgctccaagaccatctattcggtgacaacaccattctcgtcaagtctgcttctggattcgtctgcatgaggcccacagaaccagagctgaggaaa

SEQ ID NO: 894 - DNA, 500 bp, Homo sapiens
tttcattagctgggaaacagcttccaatctcatagctgggcagctgcccttcaaagacactgctttctcccctgcttgctcgctacaagtcttatgttacaaatcctatgagagggagagggggagcctctgaccaccaggcaaacggaaatacattttaaacatctgcaaggcatggtttgcacccctttggggtgaccctcactgcactgaaacaaaggcaatttgcagacaaggccccagatttaccgaaagcaagtgaatacaatgcaaccaattaccctgtttggactggatggcaatgaaggaaaccaggcccctcagaatggctggcttacagcaatctattgtcctcttggacttctggatgcttgagtttcaatttctcttaaagcaattaaggagcacctcacctgcataagaactgcaggccccagatatttgtctccgttccaccagtagctggggcagctggtgctacagcaggcacagagaatgca

SEQ ID NO: 895 - DNA, 500 bp, Homo sapiens
gcgcggcctgccaggaagcggcaagtccacgctggcacgggtcatcgtggacaagtaccgtgatggcaccaagatggtgtcggctgacgcttacaagatcacccccggcgctcgaggagccttctccgaggagtacaagcggctcgatgaggacctggctgcctactgccgccgccgggacatcagaattcttgtgcttgatgacaccaaccacgaacgggaacggctggagcagctctttgaaatggccgaccagtaccagtaccaggtggtgctggtggagcccaagacggcgtggcggctggactgtgcccagctcaaggagaagaaccagtggcagctgtcggctgatgacctgaagaagctgaagcctgggctggagaaggacttcctgccgctctacttcggctggttcctgaccaagaagagctctgagaccctccgcaaagccggccaggtcttcctggaagagctggggaaccacaaggccttcaagaagg

SEQ ID NO: 896 - DNA, 500 bp, Homo sapiens
ccagcctgggtaataaagtgagactctgtctaaaaataaagaaagaaataaataaaaaggaagaaattaaaaaagataaataaatagatacataaaatgcaaaagcaagaggcaacagtgccttccagatctctcctcggagtaagcagcataatcccacagcgagatggtatctgcgagtagtggcactgaagtgtgatcatctcgcatttgcccctctccctggctcacaaatgtgacagggaaaggcggtggcacaaaacaccaggcacagtgactgcacacaaaaccattgctcaaaagctacttgttctactgagtcggcagtgtaggactctcttctgataaaattaacaacaacagcaggaatataatggcccgtttcctggatatatggcctttcacagttaagagtttccatacacattaaagtgatgcctggaggagtatcaggcaggcgtctctattttcattttcttttctttctttttttttttttt

SEQ ID NO: 897 - DNA, 500 bp, Homo sapiens
tgccaggcaaggcccactgcatgttggcaggcagcctgttttctgaagccatggcacagacaagaatactcattcctacttgtgtcgggttaaacgccgctacactgttgggctgtatctgagttgtttttgatgtaattatttaatgataaacgtctgctcgccggtgttgagactttggagtgggcttcatccattcatcctgatcgttcctccatgagacagggtccctttgttgctggctggaagcggccgggaagcgtgggctcgctgtggcatgggcaatgccacacggctccagggaagcgttcagctttccaaaccagtgtctgggctcgtggccactcctgaaattcagttgccgtctttgaagcttcgaagaaagtttctaggattttcacttttgtattaaaagatatctgtatgcttttctctctttttctggttcacttatattcttattcagtgcaatttcctgatttcacgagaatgagaagcat

SEQ ID NO: 898 - DNA, 500 bp, Homo sapiens
gaatctttatcatttctctgtaaggccgagaatctgccctttgctacttgaatcttgtgtcagccttcagtcaaaactaatgaaagtctgggccaatgagctggccccagatttctggatcatccaagcatctccttcactctctggaccctctcacctgcccaccccctggaaccacactgtcctctgtcaccaacagtgaggtgggggagtgttcttacaacttcatcgttcactcacatgggagaccgtgagtattctcttcagaggagaggaattgtttctccttagagaggcgtgagatgaatgagtgtcctgttctccctagagtccccgattcatggtgtctggccactcctacaggcacagcacggacaatcacataacgaagctgaaagcaatgtgcttttgagtataagccatactggttagaggtgatttactgtgtcactctgtcacattgacatgtttgagactcatgtaaactattccctgatcag

SEQ ID NO: 899 - DNA, 500 bp, Homo sapiens
aatatgaaaaatgaacattccatttttaaacttggctacaagctgtttaacaaaatgtaaattcttgttcagttttgtttgtttgttcatttttagtttgtgtatctttgaaggattttctgaggaggatttactcttcccactcagtagcttatcagatatcaagggctctttcataatgcacaaacttgtaagagcaataagtgtacagcatctccatgtcccatatgctatagaacagaaccaccacggactccggaacacggggtgagaagggcctttgttggctcttcttgcctggcaggcccttcaatgcagacattcattctactaagttccaccctcagtccccatcttgcctcattcaatgatctcactgcagaggtgctctctggtccaatccaaccctgtctcctggggatctgggcctacatcccaagctgcctctggacagctccatctgggagccacagcagcggctcaaacacagcctcagtggg

SEQ ID NO: 900 - DNA, 500 bp, Homo sapiens
caaaaactaaactaaaccaaaaacaataaatgccaaacaatactcaaagaactaccaaattattccctgggcccctgaatcagatggagctgaatcattctggctgctaactgagtgaagggtgttggggaaaagtgccattgtgtaagttaaggaaagggtcagagaaccgaaaagacggcagctgtatgaaagggcttctgtgctgggattctccttttaagctatccaaaggcacaaatcaagaaccgcaaccttggagatatgacaaatgaacacaattctggttttttgttttattttaaagtgaaattccactgtttcccaagaatttgcacatgaagctttacatatttttcatgtcagcccccttccttgccacctttgttttccagcctgcctccccttaacagctggacacatcaccgttccatttttctattagttgtgactgaagtagcttgaggtcaattatttccccagcaattgacaaagaatct

SEQ ID NO: 901 - DNA, 500 bp, Homo sapiens
cacctggctgtcttcacctggtgtcccacaagtacttcaaactctgctctccaaagctctgctcattgtcttcccactcgccatccttaccagcccctacccacactaccttgctcttcctgaatcctttgtcctcactaggacaccaccctctactctgctgaccaggcaaacaaaaggacccaggcgaacaaaaggaccagtgttgcccaaggcctctgcagaggtctgtgcatgcatctcagagagcgaactaaccatgggagttcagcactgatcctattgtgtccttccactggctttttgtctgagctcccactggaaaaaccctgcattcttacttgatgaattttcaaaagcagccagggctttattatcaactgtcttttatgaataatcaaagtccaatggggactccctaattagcctgggcatgaaggccatttgcataacatattgaatgcctctggagtgtcaggtacctcagtagacatgatggt

SEQ ID NO: 902 - DNA, 500 bp, Homo sapiens
aagaccaaagtcaaatctgtaggtccccatggttcacagcacacacggaatccagccaaaggcctggctaacatccttcatgcgttcagtgaccatcagagcagtctccctcgtgtaaattcggcgcgtaccaggctggggacagtgctcactctattcgagaggtctgggcaagcctcccagcagctgtcattgatgggatgcagactgccacgcagacgttgattgaggacgttggccaaatgcatccggctgcacccgtgctttaggtcctctctaccttaagaaagggagccacgttagctcaggagggctaccttttccttcctggagagaagatggaagagatcgcagtgtgtttgcatgtttcttcagtaaaacagacatcctggaggtgaacttttgagtctgagcaacataagcttgttctgacctgacagatgcttgcctttactctgtggaaagaagtgtgttagccagtgtcggattccagccggtaa

SEQ ID NO: 903 - DNA, 500 bp, Homo sapiens
tgacctcagaaagggttcagaaagaaatggaggcaagttctcccccagtgcctgccctgctgccttttcaggcccagccaggccctggctcccctgcctgtttgaagaggtagaaaggcacagggcaaaaaaacaagatcctgcagcagcagcccctcatgggggaggtgggtgcaggctgaacgctgactgggccctttgctttgtacccatcctgcttattcccacacaacaaaagcgctgctcagccgcctggccagctccattgtgcacttaccacaaagtgctgagtccaagggcttccctggccccatgacctcactccctctcccccggcctagaggcaaggccagggagtcaaagccatccacaaaattccactgagcatctatgctgcttggcgtgtagccctggtgtccagaagcccaaggttcgaaatgccctggttacatatggggagctgtcatggtcctcttaatgtcagatatcacctctaaatc

SEQ ID NO: 904 - DNA, 500 bp, Homo sapiens
tccagcctgggcgacagagcgagactctgtctcaaaaaaaaaaaaaagacttaggaaatagcagatgaagcacaggcagaatttatccaggaaggtatggaatggggtttgggacatgagtcacaaaggggaaaccagattccttcagtgtgttaacttctctaaggaagctagaggacactggggcctgggaggtgtcctctaagccaagatctttcagaacaaaggttctatcttcaccacagagagcggtccggaaagggcagaggtgacctggcaaacttggagagaggggccttgtccttgtggctcctggtccagtgccagggtcttggggctcagaggctgtaagaagtggagccagtgagccctaggcatgtaagataatattttaagtgctcacttttccctgagcactctctgaacaccacagctattaaagataagcctcaatcccctagaggtcaccaggctctgaggaccaagcccagccctgcctc

SEQ ID NO: 905 - DNA, 500 bp, Homo sapiens
gaacatctgctgaagacaaaacttgtgtttatagctcttcacttcaaaagactggccgtgttataaaaagaaagggaccatctgtccctcttctggaccccagcgcctcttggaagagatttctgtgcaagaaggcagtgagaagtcagcgtcgacttcagggaactattttggggccggaaaagaatagtgcctacccgccaaggggaccgtcgccggcagatgaaagccagctttgaggaggccatgcgatgggagatgctggcccggaggaggtgggctgtgcgccaatgatgctgcccagatattccagcagagcagagaccccagagcagagaaccaactggcaggaccgagggatgtgagggaaggcgaaggggaagggctgtgaggcactgcagctcccaggagcaggcatgagaaatgtcagcaacagcttgctgccacgcagagtcagatatcatgtttgcatcacccatgtgcgttccttcacccgactt

SEQ ID NO: 906 - DNA, 500 bp, Homo sapiens
taaacaatatagtgaaagaatggggtttagggggattatttgcaaaaccagataaaaaggacagagtggaaaaggcaaaacgttattttggccccatcagtgcagtatcgtatctgcacataacgtaaatttgagagggaaaaaccaggtttccggagagcgaatgcaaatcagtggaggctggctcggtgctcatttgcatttgaatgcttggaacattccctgcgagacgagatgtgcagaacattccgccgccgcctcacccagcagacaatgctgatgtttgtgctgtcaccagtgggcttgttcgtaataatatcaacctcttttaaaattaagggaaggcaaatgaatatttattctctgtagtcaggctgtgtggcacttcgtggctgaaccgacagaattgtgttcaccagaccccaaaaacttttacagccccatctatagatatgatcaatacacacagggccagagaagtatgttatactcttcacaaa

SEQ ID NO: 907 - DNA, 500 bp, Homo sapiens
tcctttgtcctcaccagccgtccacttcagaagtggtggtgttattctgaggcagggcttgggatgccatatagaataaagctatgattgtactaaaaaccaccagaggataagcggctaacacaaacatgaagaaggcctaagcacatgctgtaccaggggaaagaatgagcgaatgatgcattgagactgctttgtttctgaggtctgggtgctcacaggcagccccaatacgcttgctagtgaggtcgataggatttgtttggtaagcgtactaaattctggggcccaaagccctgtctcctgaaaggtgccagcctaagtgtctaagattccttatgaattgggagggctccatgctgtgttcttgggttctggtggcattggggacctccctcgcccctcatgcacacacatacatctactatcttcctcagagctcaaccctagaaatccaagcttccctccataagttccaacaaacaccacagccttctgct

SEQ ID NO: 908 - DNA, 500 bp, Homo sapiens
cctcaaacttctgggctcaagtgatcctcccgcctcagcctttaaagtatctgggactgcagctgcacaccctcatgcctggctaatgtctttaatttccttgtggtagtcagactttccatagatggatctcccaattcctgtcttaaggattctgtcgttggagccactgtcatatactcatataagaaaagaagagaagtgggcgagggtcccagcatccagtttgctgtattcaattaatcctcacgtttcctgtatactcccatgctcaactgtgtatcatatcttctcagtctagacagacactctttgttttaccctttccagagaataaatccccaaagcctgctggtgtggtgagatgtacacacttggttgcaagaagttgagaaaaggatctggggatttggcctgttctgaaccagcatttcaagcaatcctccttgtttcaaccatactctcacactttatggaggtacctggtgctgctaatcctg

SEQ ID NO: 909 - DNA, 500 bp, Homo sapiens
gactggggctggagcttttctagctgctcttttattacaaccttgcttcttcctttcaaaagacagttttgcttgatctgccaaatacttttcgaagcctgatgcttcattaagcatgatttttctgggctttttctcctgtttctgagggatctgggtaccaaaaggtgtcatctggccagtgcggatgagctcttcccaggcagtctcctggacaggcatgagcatgctgccaagactggatggccccggctctgaaagaacaatagcaatgcgtttcgcactagcatgaaactttccgagggtacaaaagaaatgctcactctttcaagaaatattaggcagctacaaataactcatataaaaaaagaatcatccatgtactaaagcatgttacatatgaaggacagaataaaattatagcatcatgctatatttaatatattcctgttcaaaaagacaacttctcagtaacttttccccaaaatatttcactataa

SEQ ID NO: 910 - DNA, 500 bp, Homo sapiens
gcaataagatccgtgcctggaaattaagggacatttttcagccctgaaacaaagtaatgcaacacttaaacagtgctagaaatattagggttttcagaaagctccggggaacctgagagatgtgaacctgttccacgaggctgctagttagtattctgatcactggaggctcaaagcgtacccagaacttactcgtgattaacattgattgtgtacacagcatattttaaaccgctaacaatccattgtcgtgaataagtgagtctctgtgtgctgctgcttccgaggctctggtagcacggctgccccgtgtggcccagggacagcaggtgcggggctgcagccccacagccctggagcttgggtttgactctggctctgaaaccttcagcattgtgttagctgatctctggttcccatctgtgggacttccgtctcatctgagcctggggatgcagtgcagaaaatgtaaggagacctgggagctgctgcttgagagc

SEQ ID NO: 911 - DNA, 500 bp, Homo sapiens; identical to SEQ ID NO: 15

SEQ ID NO: 912 - DNA, 500 bp, Homo sapiens
gatgtcacagcatcatgcagcaggtcaaacaaggcatctcctagtattgcatcctacagatgtgctgtaaacatcaaaagaagacggtgggatcaggagatggtgagtgttaaatgtctgggccttaattgcacggctgttttgttggttagtcggtgtctgctaaggcggagattgggggatgttgtctctgcttaaaatggactggggaaagaagggctgttttacctaaatcgtttttcaggctgccgggttaagacaaaggcctgtaagagtcatataggaattaaaatatgtagaattattcttgctccagctctgtctgttatttttaagtgttcttacagaatttttcataaacataagatgatttttcaattgcaaaaccccagataagctttaaaatgagtagttaacagtatttaagcattgtaaaaatatagatttctttttgggaggcagagctaattggccccctctttgctcttgtgaattatgaa

SEQ ID NO: 913 - DNA, 500 bp, Homo sapiens
tacctgtctctttgtgttaaagtggggacaagcaaagtagcagaggagagagtcgaccgaggcgggagggaggtggcaggtggaatgaaatatcgggcagtttcatgtgcggagctgatgtcgccggcataacaagaaagggttgcacagaacaaatctctattgttccctgtcatctttaaatgagtgtcaaagtaggcaggggggctttgaccgttaaccgcacaatttagcctgcctgttgtgtctcgcgggccccacctccttggagtttctcagattagaaaagaacgccccagccccttataaatgggccatctcttgttctttgtgtccggactgcctagtgtgaaatccacagtgacgttaaatgttttctaatgaataattactgaaaggaaatggagggctatatgtgtaatggattgtagcgcattaaaatgttttattttgcgcacaaaaatgttgtccttcacaagcaccatgattgttgcgaaaag

SEQ ID NO: 914 - DNA, 500 bp, Homo sapiens
aataaagtttatctctttactcactcaacagcaatccttttggggcaaatcacttatgatttccttccaggactgaagaaaacatgcacagacggaaggtgggggctggtactggtgctgagcctggcatggggagagaggaaacaagagtgaaaagactctttcattctcctggcaaaggcagccttgcagctggggccagggtctgtggtgctgatccatctgctgggccgtcacctcccgagagagcgtgtgttcctccaaccacgcgtgtcttagcaccagtctctggcaggagccaggagatggggaagacaatttaaatgattcacataacttcaaaaaatgtggataagcactttatttttctcacaaaccaagaatatctactcaatttaaacttttacctgcgatctctcttcctcagacccagggtcacgaacttgccgtctaacctggcaggtcagtaaaaccttaccccatcaggtcttcatctgtaa

SEQ ID NO: 915 - DNA, 500 bp, Homo sapiens
tttgcaagtgtctgtgtgtggtacgagaattcgtattgtgttctctgctgttttcagagttgtttcagtcaaagaaaaaaaaatgcccgtcttaaaacttttcctctgcttcaaatacagctcccaagcccaggctgattggaattaatctgtcctcccttaaaagggcaaaagcacaaggctcagccctggctttcccagctcctctggtctcgctgctccacggacgtgtgacgtacgctggtgaaacgaagcccgcttgaatgggggcttcactattgtgtgctgctgaacctaggcctagcgcctggcaggctttggtgaatgttcagaaaatgacaattcatttcgtgtcagcgagggcacaccagctttgaatattttgctgctgttcaaatgcacaattttgacaattacctagcaatgtccaaagtcgtcataattgttagtgtcttgcacgtgatgttccttataaccatgtaataaatacagtgtgaagt

SEQ ID NO: 916 - DNA, 500 bp, Homo sapiens
ttctgcacttttattctgcagttgggctcccgctccagggggctccgtgtttctaagaaccacagcccagcatcattaaagaaggcattattttgtgtttagtagagcactaaattggtgaaatatagttgtgattctggtagtgaatatccctgttgccacggtaacgatattatgtcatgggaggctgtctcgagtgctcctgggagcagccaggtctccgtgagctcctgtttactctaaagactccggcagcccacatgtgtgcacgctgaataaaatcgtgctgcgggaccacagtgcggggaggcaccgactctgtcattctgtcaacgcaccgcacagtcacgaacatcagcattgacatgaaatggacggttagggagctgcaaaggactcatgctcctctattgcacgaatttgtcttttcatattcaaagtacttgtaagagctccaagttccacgtactcagccactaacctcaggcatctgcacggga

SEQ ID NO: 917 - DNA, 500 bp, Homo sapiens
atgagatgaggcaattgtgatgcttattccttatgtttaacagcaaaaaacttcttgaattaatttcttaacaatgaaggggagcaaagcatacgtgaatgtactggaacaggtctcagcagaagcccagcatcaggggagccaaatccatatatttgtaattcaggagaaaaattcagataactaacagcagggaatgcattccgccatgcggacagagccaacatgctagcgtcatgtgaagtgtcccgtcactgctgtctgagggcacttaggagacatgagctgcctgagtggatctcttcacaccaagctaacagtcaagagttgcctttaaaattaatctgacaaaggcgtaaataatgaaaactcttagaaaattcaaagaaatctcaacacctgacatagtctttttacctggataattgtgtaagcaaagggctatttgcatactgtttaactgcaaatacttgaagactacctctgagatgaagaaataa

SEQ ID NO: 918 - DNA, 500 bp, Homo sapiens
tcatttccccacaggcatgattgaaaagggttgtaagattccaggaatgaactaaatgtttctctgagcccaaatcaactatcatctgaaatcgtggtgcagagaagaaaggtgcaattcctgtaaggctgtatttttccttcttctggttcatacttttgttttcttggtttttcttcacttacttcccccttagtcttccatccggttgagtgttcctactgccacagtgagagtatgatgggatttcgctaccgatgccaacagtgtcacaattaccagctctgtcaggactgcttctggaggggacatgccggtggttctcatagcaaccagcaccaaatgaaagagtacacgtcatgggtaaggcaaggtccaggcaatacttggagttggatgtgtgagtgttgcccagagttaaagggaatatcaaggatggtggcagaattaaagggcaaacttaccttccatcccaggtctagtattcagtcccccttcct

SEQ ID NO: 919 - DNA, 500 bp, Homo sapiens
tgcggtttcatttcagttggaaagaacttcatctgttgaagtgcacagacagcattcagaggctagagacgccggcatcggcacagcacacagtgccctctgttcccctggcccaggccaagagctctttgtgtgtctgagtgactggtcagcactgggcaacaaacccacgccgggagacggacagcgagccgcctcaacccaccagcctctggggagcctctcatctcgcaagcacctgcggaggcccgcccggcgccagaccagtccaggcacccagaggcctctgctctcctggagctcatgacaagtaaacaaatacacaagatggtttgggatcccgatgaataagttaagcagggcaacccaacagggaggacagggctcccgcatgtgacggacccaggagggagcgaccccccgtgttgacatggggggaaaggcgggaagtcagagaggccgggaggtcagagaggccaggaggtcagagaggccaggcc

SEQ ID NO: 920 - DNA, 500 bp, Homo sapiens
agtggaagttgtaacccatttgtaaaatcagaaatgctaagtactcctttaatgatgcaacgaataaagtgtctgtgtctgcgaggcacagcagtgagtcctctttgttttgctgtgctctgaggcgggcagcatagggattgagtggcaccagtgtttgactgcacttgcctctccatgcctcgtgacccccgggaagctggcactggctgagctcagctctgtgggcctttcttcagcactgtgggtcgtaaaagctgccttttctttgaaaactgcctgcgtcctctgggttcccagcgttggtgggatggagctgtggcgtccaggctgtgaggtctcatggggtcctgcagcagccagagcgtgcagaagacgaggaggggaagaaaggtggtaagtggcacccccggctgcgccccgaggtcaggaaggccagcaacctcctggcagagggagtgggcaccccagctggagtcagggagccaggcctggctgtg

SEQ ID NO: 921 - DNA, 500 bp, Homo sapiens
ttttaacatgtatgtaaaaggcagtttttgcatcaggaagacagttttctaaattcactacagtattttggggagtaattctttggttagatattttaagtgcatttgagaaacaaaatttagtaatcaatatatttaaaatttatattattcttccctatatttgaacaatttgtccaaaatgcaatctgttcatattggattttgcctgttcagatctaagtgggaatcagtagtttctttgtttgtcgccatggaaaccagtcagccaatctgaatggctcttagatcatacagaacgatgcaatgctccctgctctcagtgaaagttcctcactgagtgagtggggctgactcttcctgcctccggctcttgcctcccagtgccatgcaggtgcaggatgcaaccaggcggccctcagccgtgcgcttcctcagctcctttctccagggccgccggcactccacctcagacccagtactgcggctgcagcaggccc

SEQ ID NO: 922 - DNA, 500 bp, Homo sapiens
agcctttgaggaacaaagagggcttcagagcgcgctggcactccttggctcacccattgattttcatttgcacagacgcaggccctctttttgtaatcagaggggggaaagcagatctgtggaaggcaaatctaccatcagctgcctaaaaatagacccgccgcctcaccaccgtgcaaaacaggcgccggcccgctgctgtgcgctggttgcagcatgaattcgctgggcagggatttgcagtatagacgtagagttgttctggcctctgatgctgcgcccgggccttaaatggaatcgcggtctgtgataacttttgacaagagctggcaagctgagcctttctttgaaatgcactggggggctctcgcacaagagccagggctttccaacaggtgtgagctagggggtaggccctacagattattaggagggaaagttgtctatggtaaattaccaactgggggaggtcagagtcaaaatctccatagcagaattat

SEQ ID NO: 923 - DNA, 500 bp, Homo sapiens
ggaggttgtcttcgtagccagcgggtgcccaggacagccctgatggggacgccacttggctttctcctgagatgttgggcaaatgaggagaaaaggcgttttaatccctcgtcatgtctgtgagggctggaggacatgtgctgagctggaattctcaacttcagccttttttttttttccttgacacatccatcccagaaacatctgtgagatgaaacagagaaaggtcttatgaattcagctcgtactcggcctgtgctcccacccggagcaagcgagacatgaatcaccggcccaggggctcgggggccccacagagcagcctctccagaggggccccggcctttccagcgtagccgcttttgatttccccaaagccttctgatcgtctacactccacagagcatgtgcgtccaagagagagctcggcttgcaccagggtgggggagagccgctcattcctcagactgtgctgagtccaactctacaccaggctctcg

SEQ ID NO: 924 - DNA, 500 bp, Homo sapiens
tagaataggacaggaattcttccctccttcccttcccagagcgcgcaccgccttcatatgtgcactcaagataaagaagcaagtgtgagcgacctttaggaggatggaggtggaagaaccacgagggacaagtcttgcatgagtcttgtgccctccggagctgcttctggcagtagagggaggaggcttaggagacgccgtgtgtcagccttttagcgtgagtgccaggcacgtaccctttaaagcagacgcattctaaacgagtgggacgacggcattctcgcctactgactgcacttttgagccatgaaatacctcgggccacttggccattacccttggctaagcccccttgctgctacaaaatagcaaagaatgtgcatgtttgcgtgagagtgtgttgagtacgtaagtatgaatgtgtagttagtgtatatgtgcaagtgtgtatatgtgtgcatgcaggtgtgtagtgagtgtatatatgtgtgctagtgtgt

SEQ ID NO: 925 - DNA, 500 bp, Homo sapiens
ggaggcccagcttgacctctgcccttcccttcgcttgattatataagttttccaataatgtattttatttttaaagcgtaagttaggtttctatcaccaacacattctatctaaaagcccaagtcttttccttaacttgtcctaaatggccagttattaagaaattccattgagggtttggctgttgcatacagccttgtgggcattttgcttatccacgttgactttctcatctgggacactggcctacgtagtacgtgattccagcaaacagggcagtatgttgagctcttgaaataagtatgttgtgacagcctttgttacagcattaaaagaacagtctactctcaatggctgaccctttatttgtatgctgacgtcaaaaacaaaacaagactgcagacacactcttgccaatgctagaaaggatgcatgtttgaagtggatttttttctatttttttgcttggagaggagggtgtgtggacaccaagctggcca

SEQ ID NO: 926 - DNA, 500 bp, Homo sapiens
ttagatgccaagtgagttgtgctgtcctttacacaattcttattcatttgggacacagacagggagctacttctacttatcagtgtagcaagactacaaagaggttaaccgaaggaatttcttcaaaggcctccaaggaatatcttctaatttgtattcaggaccttcccaggctgggaacagagatgccagtcaggatttatctctaggctaggagcgcaagctcatgtttattcattcatttggtagcgctagaaactggcaactgtgggctaaatctagcccatagacctaaatttatgtttttcttaaccttcacaatatttagaaatcagagcacttcacataggtctacattttcagcttcttttagcaggaatgctccttcaaagggtatctgcattcctgttcccacagcccccagcattccttgtcctttagctgcctggcttctctaggcacctgagttcatggtcctgggttagaagctgcagaaagga

SEQ ID NO: 927 - DNA, 500 bp, Homo sapiens
cagagctttcatgtaatcgtcaaagttctcactagagacaagtttccaggtgcccaggaatttgttgctcatcgtgatgggtgagagctcaacacagttctaagtgggattcagaagactcagataaaatgctgaggcctcagaagattcttttcaaggatgcccaaagcgtgtgactcttacagagacccaatggggaaaggcagtgtcgggactaagcaatgaatggctcttcaatggccagctgcccgcccaataggataaaagaaaaccccacataatacttccctttgtctccaaaaaaatttataaaatgaatgagattactatttgaatcttcaaaaattttttgatcaatcttacatttataagaaggcttaggcccttcatgctttggaaaagactgcatgaattctgtgatcatgaatgaatgtgtgtgtgtttaggcatgtcggtcactctcaatcctgagtctgcacaattaagaattcttattgaaa

SEQ ID NO: 928 - DNA, 500 bp, Homo sapiens
ttttgttattcctgtcacaacttagaagttcgagtgctcacatggtaagctttgatttccatcgagaggaaaggctttatgttttataaaaaatatatactaaagtaatctacacgaagcttaggatgagttgaaagggtactgccaaaacgcggccctgcccaggacacacagcagaggtctggagtggggacagtgcggccagcatgtgtggggaaggaagcaggctgacggaggcaaagcagattccgaagaacaaaagcagctttagtttgcctgggcaacaggctcaacttctgtctccacttcagttatcaggagaccagaagccgattctagggaccagaagagaatgtagggtcacatcaccaagatttaatttcataccaaccccgcaacatgaatgtgacctctggacaccgggagagtaacactcaaggttatgacatatgagtcaataacccatttcttcaaagaaaaacttgcccacctgtaccaga

SEQ ID NO: 929 - DNA, 500 bp, Homo sapiens
tgtcagctgggatggcattcctggctgtgcagagctctgtcctgctgctgctcccgcccccagaccaggacccagcccaccacagctcgtcacatcccaaagcgcccagcggctgtcggggcgcctggggccggggtgctggggtgccgggagcaggcatgtagccctagccagggggccccgatgcggacgcggtgaggtgggggtttgcctgagacagtgtctctctctgtcccagatgaaggtcaccgtgtccaaagggggcgaccgggacagtgacgacgacagcgtcctcgaagccaccagctcccgggacccgctcagcgatgtgagtacccagctgcccgcgcccggaggctccgagtctgggccgcctgcccgctgcgccccgcacaagggcgtccagtccgagtctgggccgcctgcccactgtgccctgcacaagggcgtccagtccgagtctgggccccctgcccgctgcaccctgcacaagggcgtcc

SEQ ID NO: 930 - DNA, 500 bp, Homo sapiens
ggagaggataaaacgctgcagttgtttacttgcctctctggagcaaaagagtctcttcgcctacaatatagatgccaaatcctcaggtcctgagtgaggaaatgatgagcttcgccggggattggcatgaagtcctgtgctccaagatagcacggcattttacttgaaagcattcgttgtttaaagagaaaacgagaattgtgggattttttgtcaatcgagagtcagccaacttcctctcccactggccgctcacacagaatgcccaccgtgccctgcggtgccctgccacggagccaggctggcctgctctctggccaccgaaggcacttgcttctctttcggaatctgatcacaggcaacttaaatttgccaacgttacccatattagtaattgcaaaataataaacatggcaaatttcctattaataaggcatccagtgtaactccttttgcagaaagagctctctggaatcctaagcctaataggtctgtgttta

SEQ ID NO: 931 - DNA, 500 bp, Homo sapiens
acagacaacatgatgagctaatcgaaatttgcaaaataatgacgtacctccagcaaatattcctcctcctgaggcccagtcttagaataacaataatgagaccattattagagaagggcattaaaatgctgcactgctgctaaacagagaacttaattgttctggtcttgtccattgaatcaacaacctattgttgtggacttgaaaaataaaggactggagaatgggtgccatgatgattggtctgtgcggccataccggcactctgtagaattgttttcttttgaaactcttgatggactagtagttttgtttaaaagtaacataaaaggcgattgtctggataaaaagtcctatttattgaaatccttagaagcagttgcatggatttgttcgtgacccctgagataaaaacatagtgaccataataacaccatttgtagagagccctgttaccactgcctacagtaacataagataagagacagtcttttctaact

SEQ ID NO: 932 - DNA, 500 bp, Homo sapiens
acccgcctggctcccagcaggaccccctgactcaggccctgctgggaccaggccactgcattttccccaagtggaacatccctggaaagtcacaaacatggggccagatgtgcgggtgccgtcccgcggcgggaacgaggcaggtggctggcggccggagtctatgcactctcgttttctcggcggagccacttgtgtgtgctggagcgaggacactgactaacaacggcggcagtgtctgcggaacagcgttccattgagcgcaggaaaggccttttgaagtggggacagttttaagaggcagcattcctcgcctcacatttcggctctggggcgtggacagagggtgccacagataccctttgggaggcccccgtccccctttaaaccaagcagctgctttcaccgtcacagcctgtgggccgtctcccctgggaccctcctcagcatgggcttcagctgcacgccagcccccaacagggctggagacggggtctctg

SEQ ID NO: 933 - DNA, 500 bp, Homo sapiens
tgtcactcagataaaaaaaggttcctttacatggaattgtgtgtttaactggcaacatataattttatttttaaaaaaatgaagagcaattgctgttgaagccatttcagggacgagagaaggggaggctctgtcagcacaatgggaacaaaaaactgttgtgcactaagcattattccaatcatttgcttcatagttaagtttaattgcacattacacactgtcctgtaattatgtcgcttggggaaccgccaaattcccccttgaaatgttagaagtcccttagtttattttaaagtcttggcgtcgcctccaccagcaccctgccttaatgcacagaggctacttggttcctgttcccttcaatgcatactgttgtcctgcgagggatccactctatggtctgactcctggtacagagggctgatgatgctcagagctcccagagcactggtccagtgcagtctgtttataatatactcgtgtgacttttttcttta

SEQ ID NO: 934 - DNA, 500 bp, Homo sapiens
gagcagccggttagtaatgtacagtggatagagcctttctttcaaatcccagggcagtgggtccttcaaggctagcattgcattttcaattagctgctgagtgaatgcttggcatgtgtattagtgaagaggcacacaattagcgtattgttcctttctgtattgtgctgagaggatccaagggattggtgggggaacaggcaagccaggcatcaccgtggatgttgaagaagggggttactcaaacctcggcatcttcacttgctcgatctggaattacagctatttattacgaagcactctgtgtggcttagtggagtgtgtctgaggaaacacatcccggacaccacttagggttagtctttctgagctcttcacatctctgactaattatcatcattaccatggagcccaacagtcccaaaaagatacagtttgccgtgcctgtattccagagtcagattgcacctgaagcagcagagcaggtatgtgaaattgca

SEQ ID NO: 935 - DNA, 500 bp, Homo sapiens
ttggtgatacttaaactggaagatgattctaagaataataatgcaacttgtttctctgagcttcatcacacccagcttttcaagtggaactaaaattagtaatgagtattggaaacattgccagtgaacatatgaaaggagggcattcagctaatttggggctaccagaaaatgctctgccaggcctcctggataaatggggagtcagccgtgacagctgccgcttgcaagtgtcttcattgtgccagtcgctcctcacacatcctttcatttaatcctcacattatgaggtgtaatgtctttaataagcttattttatgggtaggaaattagggttatgaggttaaatatcttgtcctagatgacaaagctaatgagtaatagaaccaggattagaacccatgtaaatctttgctgtttctgccgctacaccactcccaagatgagtttctcatctgcatgtgtgagcctctgcttaatgctgctgttttgttctcctc

SEQ ID NO: 936 - DNA, 500 bp, Homo sapiens
tcttctgcttaaaataggcaagaagcaacagcggctgccacatttttttctctctctcacaaaactggaattcttctcgtggaaaagaaagagtgggcaccaattaagtattaacaaaatacagatgaactgtttactaccttcaataatctttatatgccattgataagcaaaagactactgggatactgtgggactgtaacccatagagtttcttagatgctattggagagataaaaggattggcaccgaggattcaagagaacaatggaatcaacactgaatgggaatcaaataatctgtgaagtcctgactgccactccccacactagctccagtgttgatcacagtaagagctgtcaccactttattttgagatggaaataatctcgcttttctcactctgtcacccaggctgaagtgcagtggcgtgatcttggctcactgcaacctccacctccctggttcaagcaattcccctgcctcagcctcccaactcg

SEQ ID NO: 937 - DNA, 500 bp, Homo sapiens
cttttactgatttaaataacatcttaccgtggtgtcgtcttcaacatcagcatctcattttctctgggaaacttaaaggtcgtcttgttctgtagagtcggaactgtttctggctgtgggctgtgcttgcctgctcagctgcattgtgttgctgtgagctgaagctctgcaaccacctgatcagtaccacataggaggactgcagagctgtcgctggtgctgactcaaatttatggcaagaggtgcacacgcaacaaaatggacaattttttaaaaaatttgtggcatcaagcgtacctatatatctgatttgctataggatgggataccttatgcatgagagttggcccttactcctttctatgtatttgtctgagattgggttccatattttaacatttgcctcattaagaatctgtgaatttttaaaatacctctactctttatcctttttacatgttgaaaataaatttgaccttcctcatggatagttttctatg

SEQ ID NO: 938 - DNA, 500 bp, Homo sapiens
actactggagcatttatatccaaaaggcagtctctccaggctgccccacagttctctagatttgttgttactttcaacaaatgctaaatgtatagtcagcaatggaaagactagagaaatgtaaaagatttcataataaatatttatgttggctgtcttgtgttaatggtttccctacaagcagctgcggaagatgttgatgtaactgatctcattgaataagagcctcacacccatccgctccccatccggccccgcacttgattggtggatctcagagaaagacagaacagtcttgtgcattcggaccctgccaggctgcaaggggccattgtggtgcagtgacactgaaactgaatgttctcagcacaaacacattataattcactcccacacacacacaacagcatcgctcacaggcactcaggaatccaacacgccagtgagaaagcacatgactatgaatgcagtcagtttatggagttttaacaatcagttct

SEQ ID NO: 939 - DNA, 500 bp, Homo sapiens
ataaaggactacagattgtgcagggacagagctttgagcattctattcatgccatggctttctttcaaagtcactggaagataaagaagcaattgtgactttggaaatcttccacatacaagctgtgtgttgcttgaaaaactacttctctggtagcaaaaaacatgggtgatcagttccaggagcggggagggctacacaaaccatgcctgacttaataaaaatctatgcggagccacatcggatgaacgaccactatgaatgctctagtctgcatctacttgggatggtagtggtgggggatggcaggtgcatatttggaaacaggtagcctattaactacttttcaacagtaaaattagctcttttctgtttccaggcatctgagcatctcagcatataataaaaattcatctctcactgcagttctggctgaaaatcttccagtgtccctctgaccagaagtaaaattaggacgcctgcagaacaatatgccctcc

SEQ ID NO: 940 - DNA, 500 bp, Homo sapiens
taagaatcccaataataaaagaagtaggctttaagaaagtttaggatttctttgcctacttggggcaaggaggtaactattgcggctttgcataaacaaagatcatgtacctgtcaaaaaatgacttaattttaaaaagtgatggtagtattaaatccaaactgaaggcagaatataccccagctttcattatagagtgaagactcatcatgcaggacgttggctgaaacgaaaggacaccacccgaggcgtgaaacatcgccatggatgttcttggaaagacatctgctgctctggcacgcaaatgctgtctccgagggctcgtgccatatgcaccagctggtggatcctgctgcctccctgcacatgtacggaagccacgtaccgaacctggttctccaagaagtgcatgtagcggtaaagcagtgtgtaggagggagagaggatgcccacagacttcatccgcgcgccacgttccagctcgctctccacgggcatgt

SEQ ID NO: 941 - DNA, 500 bp, Homo sapiens
acgctaagcctggccctcagcctgccagcgtttccgcctggctcacgatgttccacgctgttcctccaggcgtccctgagggcctccatcctcgctcgggactgtgcggctgcggcggctattgtgttcttggtggaccggttcctgtatgggctcgacgtctctggaaaacttctgcaggtcgccaaaggtctccacaagttgcagccagccacgccaattgccccgcaggtggttattcgccaagcccgaatctccgtgaactcaggtatgctccctcctgctggccgcccccgcgtcctcagtgtcttctggtccccttccctcccgagctacttgacctctgtgggacacccggagcacccgggccctgcgtgccatctttccgagcccggggctcccctcccccgcccctgtgcccttccacccgcctctttgccagcacaaaggccctggcataaagggtttcagagccaaaagcagtagagaaaattgtgaaa

SEQ ID NO: 942 - DNA, 500 bp, Homo sapiens
aaagcgtggcccttttgaatcataacgtgctgttcatttctattcccattgcttctcctaggatttcttatctcttgccctagcaaaccataacacatagacacacacacccatccctgtccagtgcacccagtgggggggagggggcagagaagacaaagtcatttatgtaatgtgtctccctgctgagcccctaatggccgaagcttttgttctgcattcagtggctgcatgtgatgggcaggaagccgcagtctccctttgttccatggccttattcagcaatttagatccatcataaaaatcaaatatgcatgttgcagtcgccttccatacaacagcttcaattttcacctttttttaatttgaactccacaggggaagaaagaaaatgaagggagaaagggaaaatgggggtaagaaaaaaaattgctttgtgtttttgcttagtggactgtgaaaataggcagtcacaaaaagaaaatttttttaatttcata

SEQ ID NO: 943 - DNA, 500 bp, Homo sapiens
aagaggggagccttcccctgccagccaggacagaaggtgccgaaagagggagaaactagcttcttaattttctggagaaagggtggctgggtggggggagcgtcccattgttccaccagccgctgagggatattaagcagccgggaaacagagccttggcatgggcagtgtggccggaacccgccacaaagggccactcccagagcgggctcattagggagccgggccggtgccgtgcgcggtgacaggcgggcgcattcagggccccacacaatcgggcccttgtggcgggcgggggagcaccgcgctcaaaggagcctctgattcctagacaagagcgggcctccttcttgccttacaacctgggagccaacggaaagacagatttgggaagacaaagagatgcttcccctgacagtggatggtctatttttggaaatgggtcgactcttctccatagctgccgtttcggtgccaccggccctgcctgcctctgtccc

SEQ ID NO: 944 - DNA, 500 bp, Homo sapiens
gaacagattccttattgctgagcagtgaatggcttctagtactccattattgctccgggaacatgttagtaataattatgaaaggtaggataccatgaaatctgtaaggtgatttggcagaagtcgatgctgttggtgccaggatttgggtaccgtaccacggtttcctgttttcaaatgtattaattgatccgcaaaggacatcttttggagacaagaattcagacagactggcacagcctggacctccgccaagactgctcggaaggttgccatactgggagcaaaagagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctattt

SEQ ID NO: 945 - DNA, 500 bp, Homo sapiens
tccacctgcctcagcctccccgagtgctgggattacaggcatgagccacctcgcctggcctataaactacgactctgatgaccgcatagtatttaagcaagaaaacaaccaaaatgttctagctaaagtggagaccacttaacctaacccaattaaactttaagttgaacacaagagtagtagatgcagttcagctccatgacattgggtgagttgtctaaatgctctgtgctttggtgtccttgtctgcgtgtgacatgaagccgcagatctcaaagatctctttcattccgtgaaagcgctctcaatgtgtgaagttgactgcttctcctgctgtttaccaagagaataatcttaactctacattgtggagatcggatttgttctcacttgacagaaagccagtcccacgagcagcttggtacccaaataccagtctgtttagtgctcattagagatgaagaaccatattcataagtcaagctgagacggagtgtcat

SEQ ID NO: 946 - DNA, 500 bp, Homo sapiens
gtgctttttgcccgttgcctagacgatcacttggtttctctgaggatgtctggttctcgtaaagagtttgatgtgaaacagattttgaaaatcagatggaggtggtttggtcatcaagcatcatctcctaattctacagttgacagccagcagggagaattttggaaccgaggacagactggagcaaacggtgggagaaagtttttagatccatgtagcctacaattgcctttggcttcaattggttaccgaaggtccagccaactggattttcagaattcaccttcttggccaatggcatccacctctgaagtccctgcatttgagtttacagcagaagattgtggcggtgcacattggctggatagaccagaagtggatgatggcactagtgaagaagaaaatgaatctgattccagttcatgcaggttgattattttcttactgttagaaaaggggtgtgggggtatggctctataatgtttttaaataatttagta

SEQ ID NO: 947 - DNA, 500 bp, Homo sapiens
gctgtgtgcctccatggcagtgaccagcaaaagcgcaagggtgccgcagccacggcgaaaagaaagtccaagggtggaggggtgaacgtggagggacgtctgtgcacctggccccctgaagacccacgtgcgtctgggggcacattgcgggggaaggaacgtgatcttcacacagaaagggacagttttaaccgttttctgttttcatgttctcatttaactgttggccggaaattgccggtaggctgccgtggcctgaccctactacgtgcacaactccgcaggcattaggggaggggtcatctgctctaattaggtaacaggggcaagtgggattaaagttttaaggcagttatattaagaagctgaggacaggattccggaaccaggtgggttttcagcgtctagccatgggtgatccagagcgactatctcttcctccctgaaaaggaagagagaggagttaggacgagagtgccgcagggtcctcccacaccagc

SEQ ID NO: 948 - DNA, 500 bp, Homo sapiens
ttggggaacaatataccttaattccgtaaattaatattttaaaattaataatctgctttgttaatttccaataaaaattaaaacctatacatgaagatcatttacaaaagatgagaaatgacacagaaaatatagagtgaacactacttaactactcctccacttttctgtttccatgtcagacacatgcctggtttctgacccttgtcagaccaggaacaaattataatttgaaagtagggcataaagcgctggagttgagacttgtaaggatgtaagagcttacaacaaaagaacataggaaagtgtggtgaaggctaaagagaattagaatgcctttccccatttggtgaatgaatagatttttgtgttttgttttagcatatcttcaggcctgaatggaatgctttgtgtagtaaacacagtaaagctcaaatcgagtttactgcctccatatggttccaaccacatacgtacaatggtagattcatggggttggg

SEQ ID NO: 949 - DNA, 500 bp, Homo sapiens
tagatatcaagtatttaaagctaagcaagttgagaaaacttaaagtatatataattatcactcttattatcttatatttcattagtaggacatgtaaatactaacaacgatagcaatgtaggcaaataaaattcacacttctgttcttctattgattgctctgttctgctgactgtgatttgaatgttagatcatggagagtaatccctttcactgtgaccaagtgttcttggtatcctcagacagaatcgttccaatgtgccgccttccctgcctttcaggtatgctttaatacctagcatacaggtgactgcacaatatgagcagatgtgaccagcttctttacttatttagtaccgaaaggccagactgagtgattgagagccaaaagtgattaaaataataccatttattctgtgttctctttatgccagaacatcacttttccactgatgacattctattctgtctgctcatgatgtaagtgcaaagcatgtaca

SEQ ID NO: 950 - DNA, 500 bp, Homo sapiens
ttatgttgaatcacacaaaggcaacttttgtttgagtatcaaatcctgcttgggatggcttccgggacccagtggcaagctcaggggcatctacacccctcccgtgagcaagaatggacggggtagacgtgggtggtctgccctctgcggtcctctgcggtggatgagaacagatgtcgctcagagaacacaagcttcattcatgatgggggcggggctcgcggcccggggaggatggcgttggtgtcgcgtcggctttagctcttaccctggaccctgtctctttacatcaccattttggctgtgttgatcccaaagacattttgactccaccatttttttttcggaaggtatttgacctcgcggatacacaaagagctcacacttggcagggtctgtgacgagtctgcagccccagacccccgtctagctcacaagcactgtgcttctttctgcacctttccttgtctctatctttctctttctatcccccaaccaaa

SEQ ID NO: 951 - DNA, 500 bp, Homo sapiens
gagaaagaaaattttcaaattacagttatatcaacagatacagaagagatcttagctagtaaaaacatccttaagcattattttgctgacgacaacaaaaatatttccagccacatatcaaaccacctacaaattctttggggatcaatttcttcatttctatagcaaagtaacatgtgcatgtctactacaaatcttaaggcaaatagtcctgttcctattcacttgtcattgcaatgaagcatctgccgctcactgtttttttgttattttttttcctgattactccaattcaaaaacatcatcctaccagctcttttagttgttaaatatccctgtgcttgtggctacatttctttgcactggagaaatgatctcattaacaaactagttctgtgcgtccttaacactgaggcccctcgcctgcagctggaggcagctctctgttcagccccagtgcagagtgacacagacaggcgacagcgtcgctgagcaccaac

SEQ ID NO: 952 - DNA, 500 bp, Homo sapiens
cattgtgtatgtaaggtgttatccagggattcctttctctcatcttcctaccctgtcactcaccataaatactaagaacagagcactaaacattaggcaaaaggcgaatttcccccacctcagttcatgctgctaaagaacttaatatgcacaagtggtggtcattgaagcagggctggaaagggcacttccatgaagagataatcgctgaatgacaaaggctgcagagactccactccaagtgggctccggacaggctggaattggcacggattctgcatacaaatgcaattaccactcttaacaataggtctccattagtcaggaggtgcccggttctgccggctgtcttgatcgtgcactatcctgaccagctttctttttgcaatacactcggaatcagtgaagtgccagtgtgcgtgattttatctagaactctttgcaccctctgttttgtggtcttattggtgttgtaatacattaccaagaatgatgtgaga

SEQ ID NO: 953 - DNA, 500 bp, Homo sapiens
aaatctgacacttttcaattcagcaactcttatcctttgaataagatctgaaacctgaggttcagtttccatctgtttccggtattaggttctgatgccataagacacttctgaaggagaaatggaacactgccctggccactcctatttcaagtcaatagcatctgctcagtgcggggatggcccacactgaaggtctgtagcattaggtagggtccagtttaaacagatgcctagtgttcaaagaaacgagaacaatgtctcttaaatgcagctgcactctaaatgtaagtgaatgcttttctagtgctgtaactccaaacttttaaataatttatcaaaatgcacaaaacaactaatggtcatacaaaaggaaattcttttacattgaaggcaaggttgagtcagtctagaaaaacacactttttagccctttgcatttagatggccagtatcacttcccacccaaagtatcaggttctctgactttgcagtgagcg

SEQ ID NO: 954 - DNA, 500 bp, Homo sapiens
ccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtac

SEQ ID NO: 955 - DNA, 500 bp, Homo sapiens
gggccgagattgtgccactgcactccagcctgggcaacagagcgagactctgtcttaaaaaaaaaaaaaatgaaaaaaaaagcagcattgaaactagcttgtcttggacagctgcacttgcattatgtaagcgcacagggaaccctgcggatacagggaaagccatgtcctcgtgttggcagccgaatggagggagtgtgggtgtccttgtctagtaactgaactggtgtgtgggccgggggctgacctcggggctgtcagtgaacacacgtggtattgaggctgccgcgtttctccctgtagtggactgctgggacgggcccgatgggaagccggtcatctaccatggctggacgcggactaccaagatcaagtttgacgacgtcgtgcaggccatcaaagaccacgcctttgttacctcgaggtcagttggctgatttctgggtggtgtgacttaaaggggaaggcagctagggttggatagacagatggacagacag

SEQ ID NO: 956 - DNA, 500 bp, Homo sapiens
cataggctgctaggctgcatgcttgcacggagaccttgccctctgagccaggctggccgtctggaggacagattcccagccactagcctgctggcttcaggctggcacatttacaatgcaaatctcttcaaatcccctgcacaaagcttctctggccactcactggccgcgtctctgtgctccctgccttctagatttctattcagattctctccagcgttcagaatgatggatcttgtcaatctgtgccggtcgttgggtggaaatggcactgcagggcctccgttctgatttccttcatcagtaggcatggcaggcatctctttggaagttaagagaccacatgtatgtgtatttccttgagcggcctgtctgtctttagggaagctcgttttgctttggttggtccttatgattgttgggactgtttatactgggaacagcctgaaacccagctctcctaggcttgctcagcaagagaaacgtgctgggtcaccgtt

SEQ ID NO: 957 - DNA, 500 bp, Homo sapiens
tcgtgtggggcgacataggggcccagggggcctggacaagtaataaggtcaagatatttttggacttgttcaaatgggtgggcagctgtttctctgaggaaacgcgcccctccccagtggccaggtgagcagtggggctggagaggagagcagagggagccgaggccctctgtccaggcggctgaggtcacgcggtctcttcagtttccatttttccacttgtaacggctgttacagccgctgtttcatcgcgtcgtcataggagttgaacaaagctgtgtgtgtgtttccagaatgttggcacagcggcgagaaggctgaccgaacaccgagaagcagccagcacaggctctccacaggggctctggcatggagcaggataacccgggcccacgtggggacacgccccgccccacaggcttgcaccggggtgcggcctgccctgtctggggcgccaaggccagtggtgtaaatccacactctatggtgacggtggatcc

SEQ ID NO: 958 - DNA, 500 bp, Homo sapiens
gaatcatcttcacaagcattaataggactcagaggctctctctgaatagttcctttttactgccctgtagagactgttgttactgggccatcaagcatttgcttgaaggaaattagggcaggacttgagcaaatactcaacaccagcaagaagagggggtgcatggaggctgtgggttttcacaggatgggtctcatccttgaggtgactgataacctctagttttcagaggactatttattctctcaccgagtcctccacgcagtctgctggactattattacaaacattgcattgatgtgggaattgccagtgacagaagctcaggccactacagtacagatggctgaggctgaaggatggagcccctgccctttgaagcccaaggagggcactgcgcgtcctgcgctcagttggcagcgcatcctacagtctggcagtcttagcaggcagcctttgctagttttatatcaacataaacattgagaatgtgtgcggag

SEQ ID NO: 959 - DNA, 500 bp, Homo sapiens
tcagacatggcagcatcagatggcgcatggcctgggacagaggacagacgcgcagcacgcagcagccatgatacagtgggagtggggatgaaaccagattctggtgcaccagccattcctgcatgggatgggtaggagggccaggtgatggcctcggcaacgcccacaggccccagcagccctggccccctgggcagccacaggcccccagcggagccccaccccgcacacagcctccaagtgcctgcacggccgtatctcccgcaattaaaatgcaggctttcaaatccatgacgctcacgcactgctcagctttctggagttttaattgcccatttgctttcttcctaggcaacagaactgctctattaatatctccccaccggtttcaggggagaggggagacaagcgaggatttgtttctgtattaattggcaaacctctttgccgcctgcttcctggacctctcagggctcgctcttcctgtctctttcttctca

SEQ ID NO: 960 - DNA, 500 bp, Homo sapiens
aggcatctgtgctgccttcacagagctcactccagagctgtgctctttgaggaaaaagaatccctggcttgtgcaggagatctccattctgtggatgctccatttcgagttcagctttggcaaggggggaggggtgtggacgagagtgctccccctcccattgcctggggggattaagaggctctattgtccctggcctgatggcccccgcatttgcatatatcaagtccctggggctgggaatagtggcgcgggctgcacctgctgccctgggttccaagggctgaccccagtgagaccttccaggtaattccatttgtgtcatcacagattcagaaatccaggcttgggagtggaataacgactcgagaagggagcgggagtcatgggtaaacacacacgtcccgggatggctgaaagtggtcagaggtctgggaaaagaacgggctttgaatccttggcgttcttttaaacaggcctttatttggagagccttccaa

SEQ ID NO: 961 - DNA, 500 bp, Homo sapiens
tctccttcaggagtttggcttaaatgcacagtaaaggtctttgtaggtttctaaaattatcttgccatgtttcattagatgtcagtgcagaaacataatttggtttagttttgtatttattctttgtgtgtccatgtatgtgtgtgtagaaatcattactttcatagactgcctcataaaaataactgaacatttggggagcactgctgcacttctaaagaaagaagaaaaggagatttgtaatttatgcggcatgcatgatgaatgtactccacagcagacaatgtcctccattcaagataccaaagcagcagacattgctgcaagaggggaactaaatgtcatagaaacagctactgtttctcccacaaatggagaggaaagtcattacacaaaccaggtccagttagaaaaaaataaaacacatatgagttcagcattagtggaaaaagaaaacaatacatcactgaatggacgtgtactggggcaagaagagtcac

SEQ ID NO: 962 - DNA, 500 bp, Homo sapiens
acagatggcagagtggagaggcagcagccagtgccggcactgcccagcctgggcggacccagctccctccgcctgccagctctccaaatgccacccttcccccatcctcccctctccccatccccccagcttggcactgatctcggggagagagagggagggaggctgggcaaagagcatctgttccctccattctcccagctccatcggctgccaacctagggccatcgtctgcctccatcacccctccgcccgcccgcctacccacccaatcccaaacgggtgctggatcaggtgctgaatccggctgcctcctcgggtaccagtcactgtgcattgctgtgtgtctgccaccgctgcctggcactcatggggccgtgtgtgtgtgtatgtgtgtgtgcgcgcatgtacatgtacgcataagcgtgtgctgtatgtgagcctcctgggcatgggtgggggttggcattgcggttgccaatctagtgtacaaccagaag

SEQ ID NO: 963 - DNA, 500 bp, Homo sapiens
tataaacctggttcaaatacatgtgaaaattataaatgtggggggtgtatgtagaatcagatgcaagactaaagacccaaacaattgttattttacattgtaaaaaatgtctgtactgacaatgatattgttagagaagagaataatggataaaactataatagcccatgtggtaaatgtaatattactaatacactttacctacataattttttctggctttaattcaatgaaatccattatcctgggcgggaatggaacctcctcatctcacgcatctttagtctcctgaactgccttaaagccttgacataataaaaggtcaagcagatcccagtaagcatttgtaaattacaatagacccccatttcagctacaagccacacattctcctgctcgctttgctcactctctggtttcatttcattgtataagcagactaatttggaaacggctgggctagggtgcttgggaatacctagattttcaaaacaatccta

SEQ ID NO: 964 - DNA, 500 bp, Homo sapiens
ggccggggagccagggggcagcgcgcccgccccactcagggtgcgggaagcggcgtgggggaggaacggggcctggcccgggcgcccctcaccgtggcccgcccgcctgcctttgccagcagttctcgatgcagatggacctgatccggcagcagcttgagttcgaggcccagcacatccgctcgctgatggaggagcgcttcggcacctcggacgagatggtgcagcgggcacaggtgcggcggtgggcggggtggcgcggcggtaggcggggccctgcgccagtgggcaaatcagagtgcagatattatgggcggggtctggggtaatgggaggagtcttatgcctcctgggttggggggcgcgggttctggttcaggaggcggggccagaagctggaggtgttggtgggtggagtcaggaggctcagagcctgagcacaagggcggtggggtgcgacagtggaaggtggcatggcctgtgggcagggccagatcagc

SEQ ID NO: 965 - DNA, 500 bp, Homo sapiens
tcccgggtgcgctgctccaccaaatgctcgtagttctcctgcgcacggcccaaactggcttccagcgagctccgcaggccctctcgctcctggcgctgctgccgggtccgaccctgtagcagcgcctcgtggcgcgcccgctcggcccggctcagctcccgcttctcccgctgcagctggccctcctgccgctgcttggcgcgggccgcgcgctgggcgcgctccctgcggatctgctcagcccgctcccgcccttcctgtagaccttcctcacgttgcttcaggttctgctcctgctgaagcttgcgcagccgatcctcccgggccgcgcgctccgcccgctcccgccgcaggaggccctggcgttcggccagctcccgccgccgctcctcgctgcgctcgtactgccgctgccgccgccgcgccgcctcgcgctcttcgcggccacggcggcctcgccgctcctccacctgcgcggcccaggctcggcggccctgctc

SEQ ID NO: 966 - DNA, 500 bp, Homo sapiens
cagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagctcggccctgcccaggcgccggcccccc

SEQ ID NO: 967 - DNA, 500 bp, Homo sapiens
tgctcgtagttctcctgcgcacggcccaaactggcttccagcgagctccgcaggccctctcgctcctggcgctgctgccgggtccgaccctgtagcagcgcctcgtggcgcgcccgctcggcccggctcagctcccgcttctcccgctgcagctggccctcctgccgctgcttggcgcgggccgcgcgctgggcgcgctccctgcggatctgctcagcccgctcccgcccttcctgtagaccttcctcacgttgcttcaggttctgctcctgctgaagcttgcgcagccgatcctcccgggccgcgcgctccgcccgctcccgccgcaggaggccctggcgttcggccagctcccgccgccgctcctcgctgcgctcgtactgccgctgccgccgccgcgccgcctcgcgctcttcgcggccacggcggcctcgccgctcctccacctgcgcggcccaggctcggcggccctgctctagggcgcgctgcttctcccgctc

SEQ ID NO: 968 - DNA, 500 bp, Homo sapiens
ccctgggccggcccccgagcgcccccgcagacaaggacggctcaaagcccggccggacccgcggggacggggcgctccagtcgctgtgcctcacgacgcccactgaggaggccgtgtactgcttctacggcaacgactcggacgaggagcccccggcggccgcgcccacgccaacccaccggcgcacatcggccatccctcgcgcttttacgcgggagcgtccgcagggccggaaggaggcccctgccccgtccaaggctgcaccagctgccccgccgcccgcccggacccagcccagcctcattgctgacgagaccccgccctgctactccctgagctcctccgccagctccctcagcgagcccgagccctcggagccgccggccgtccatccacgaggccgggagcccgcggtcaccaaggacccgggcccaggaggcggacgcgacagctcgcccagcccgcgggccgcggaggagcttctgcagcggtgcatcagc

SEQ ID NO: 969 - DNA, 500 bp, Homo sapiens
aggaagcgaagtgagagagagagagagacagagagagagagagagagagagagagagagagagagtgtgtgtgtgtgtgtgtgtgtgtgtgtgtgtgtgtgtgtgtgtatctgtctcgcaagcccagtgtggcccaaaggaggagttgccctccagcctcaagcccgggtcccgccgatgggcacgccctcctccctcaggctcacctgcccagccccatccctcccagtccgccacgcccccggggcccgccctgcgctcacttctccacgcccacgacgatgtagcggtcttgtaagaagtggaaccagccctgcatgagcagcgcccactggatgccgaaggctgccaacaggaagttgaagcccacggcgctgaagccgtagcgctgcaggaaagtcatgaggaagccgaagcccacgaagaccatcacgtgcacgtcctggaagcctgcggggacagtgcagcccgggactcggtggtctggcgaaggttcgtcc

SEQ ID NO: 970 - DNA, 500 bp, Homo sapiens
cccagcctccagcctcagatgtcctgaggtctcccagactccgccgtccgccttggcgtgtgggctgcggataggcctcggacctgtgtaggccttcctagctggccagtttctgtccgggtctcgctccccacactgtaccaaccctaggccgccgagagggctgttatgggcttgtttggagtccaggccattaagtgtgcgcaaatccctgcaacccagcagggtgctcgagagcgactctggaaacgccacggcccccgcctgcttatctgcctgtcaataaagggcgcgttcgggctgcgcgggagcgccggtggtgcaggcgaggcccgaactaggcccttccgagctccgggccaacgcacgagccgctctccatttgtcccgggcaaggaggctgggagggagggagccggctctggggtcgccgagggagaaggtgcgggtttagccgctgcctcagctggattcttggagaagcgctcgacctcggagca

SEQ ID NO: 971 - DNA, 500 bp, Homo sapiens
actcaggagcctgggcctgggcctgggggtggggtgggggggacaggcgtcccccccaccccaaccccacccctatccctgcccggctgtctaaacggacctaaatgctaacctgctgttgccttgactccagagacacgaaactgaagctagccctcgcccctctctgggatcccgcgctgcgctgcgggtagctgcccgcagggaggcccaacctgccgcggctggagcacggtttctgctagccgccgccgtcaacttgaacttcagtgagcctaggccggcttccttcgcgctcacctccatccaccacctaagaagtcccctcagcgcgagcgtcgctttatccggaggcagctggagccccctcgggaggcccgtcattattattattaattatcgtgatccttactgcattattaatgcccaggatgataaccggcatcggtatcagctttccctggttcagtgatatcccacgaagttcggggcggggagga

SEQ ID NO: 972 - DNA, 500 bp, Homo sapiens
ccacagccgccctgcccagcctggctcctcctcacccgcccaggctgctgtgctcctcacgggaggaaaacccgcctgcgtccagctacctccaggaaagcaacaactgcccgtcctcgactaaaggccaaaccttttaacatttttgtccttgaccacggcatcagctgtgctgtctacagaaggaactatattattcccacttaaatagctcggtgtttcgtcaagagagtgcaaacacgagggcttcggtagagggaggagacactggctcaggaaccagagctcacggttcctgctgtctctgccccttgacctcggtgtgaggcggctgcgactgggtctctgctgtgtaaatattgtgcctgagggccattttgacaatgaccgtttctactttaaaaacaaagcagaccaagggagtctctggtccagggataaggtgcctgcagtgcttttccgacacctaaatctctgctttgtcctgagagaaacaagcg

SEQ ID NO: 973 - DNA, 500 bp, Homo sapiens
tgcaaatattccagagagttaaatcatttagaaagcactagttctttcaagaacaggtagtgtgattgtctgcagtcctgggccaagctgggaaaacaaaacagcagagagaggtgtaacattaaatagcgtcctgaccacactgcgcaagaaacagcaaatgaaacgtccaaactttggaaagatctgaagaacacttgccgcccgcatttccccttgacttctccctttttcttcccaatctcgaggcgttcatgcctggctttaagacgccaagataactctcttgttttggcattgtcgcaatgtccaaatcggtcaaaggagtgggataaggtgaaaggaccaggtcagaaactttagaaggactcggtaaattaatttgtttggaagccagtgaggtggactatgttgaggtagcagttccgcaccacgactttggagccaaagaaaaacccaggccgaaaaagcgagccttgatgtctttgttctgccttggc

SEQ ID NO: 974 - DNA, 500 bp, Homo sapiens
gggggaagggagggagtatgtgcagcggggaatagttatgcagcccccaccttgatcatataacagcaagaaagtgtcccaagacccaagaaggaagttagcctagatcttatttttcaacacaatctaacagtgactttgttaagaaacagaaattcagggcctaagaggttgttggaacaatgccaggtttcgcttcctttcccgggcagctctcctgcgacgacctttgacttgggaggggcaggtcgtccatgagcacgagtgaccgggtccctgatgctttcctcgtggttacagcctcgcctgcaggttcgggcactgtggggtggggcgggaacgtggctggcactatgaagtatccacctttctgcgggctctgccgcctcatccctccaacagcaagccagggctggtggctgtactgttccctcgtccctcacctagcatcccctttttccagaggacgaaaggtaggggaagctaagaaatgatggcac

SEQ ID NO: 975 - DNA, 500 bp, Homo sapiens
cgaggccgccctccccggcaggcctcgtccacgcccttgtggcctcccagacccgctgcgctttggctaggcgtccctacgcgcctccaccttctccaggtgcacgcctgggcgcggagctaggctgagcccccagcgaggggcgtggggcgaggggcgaggggcgagggcgtgggcgccacgcaggccgcggagcctggtgggcggcgtgaagcgtgcactgcgcctgcctgcccggtcccagcctgccgcccagagctccccgaccaagccttgacagctctcggagcagcgagaagaagaagaggaggaaggacacaaagaggaggaggcggcggcgggcggcgaactgagggcagctcagggggaggaggactcattgtccggtccccccagtccaattgatatgctaatctcttttctgatgccacaacaaagaacacctttgcacttttaaaagacttttgtgccctggctacagaagtttattatccactaat

SEQ ID NO: 976 - DNA, 500 bp, Homo sapiens
tgcccggggcggggctgggagggcggagggaccgaaggtcggggaggggctttccctcggctcgccccgcctcccgcgctgggccgggggcgcgggggctcccccgagcgcaaggcgggaagagggggctcggcggcgccccgcgcccccgcccaggtcatggccgggttcccgcgaccggggcgggggcctcgcgctactcaatgacgaggcagcggggcaggtgctgcgagaaatacttgaagagctcgggggtggccccggggcagttggtcagctccagctcctccagctcctgcagctgcaccaggcccgacagcccggtggtggtgagcagcgggcagcctgcggcggggtcagagggcggctcagtgcgcgcggcccagggctcgggcggggacggccgggccgcgcctccctcctcctccgcctcggacccgggactgtgtgtccgcgccgggtgtgagtttgcacaaggaccgggcaggttgggcgggtgg

SEQ ID NO: 977 - DNA, 500 bp, Homo sapiens
gggactcagggaaggagaaggagggctcaatgagggggtcacgggcgagggataaggccttggtgaggaagtggaggttcagcgagggagcggaagctcaagaaaggggaaggggagaaagggttcggagagaggccagtgagcggcgaaggactcgggcgtggaagctctgggaaaaggatgaggtagtaggggatggggcgggacttgcggcaagggacttctaccagtaggtgggcgttggtggggcggggcccaggacggggcggtacctggagcttgcgcaactgctggagctggccgcgcaagtcactggcgctgttctgcaggcctcgcaggtgaagctgcatctgcagccggctaacggcggtaggctgacctgcgggggtgctgctggccgagggcgggggcgggccggacaccggggtggccccgctgctccggccgcctgacccacaggctgcagaggaccacgaggatgggagaaagtgaacaaactg

SEQ ID NO: 978 - DNA, 500 bp, Homo sapiens
tgctacttattatgtgcacagtggccagatctctaaagaaaacaccatcccccacccccaccccccatatagtaaaccaggtggtccgcccagtgctcccagggaggtgatgggaaatcccactccataccctgcggtgaggggttccatgccctccacgtgtgcaactactccgggcccagggaaacactgggccccatccggtaacccccggcccagtcgggtttcccagttcacattataaccaaacggtcttgccagctagacagacagacacccctgacctgtttaccctgatcctctgctctcaggattaatcacaacttgtcgaagggggtggcttccagtggggtggaccgctctgtcaatgccagcgtgtgtctagcatctcctggggtgggggtgtggggaagggaggtgtaggatgaagccctagaagcctcaggcaattgtgatccggtgggctggatactgaagcccacccctgccttgacctcaat

SEQ ID NO: 979 - DNA, 500 bp, Homo sapiens
agtcagctttctcgggcctcccgcctccttgtattttcctgtgaaatacccaggcgaaagagacccgtgacaacttgactttctcctcttcgagaggcccgtgtgagctcgagagcccacagcccgtgtttccagtgtgactctgtttactaattatggaaatatagggatcctataaaataaattgtttcaatatggctttggcgagtctgcttcttgacttcttcacccttattgtttcaaagacttcgtgtgtccttggcctttaaacttcctcttgacaatttcatcttttctcccgccacggagctcctttctactccaaacggtgcattttttccccaaatgttcacgtttctcaagtctccaggacttggcactggctttgccaaccgcagtgtctaagtatttcaacctagcagtgaattcttaggcaagctaatttaccacgttacacaaattttgtggtttctttggtacctacaagcaacattgtaata

SEQ ID NO: 980 - DNA, 500 bp, Homo sapiens
tggcgttggccggcggttctgaagatgcgctgacctggagggagggcgcgaaaggtcaggcgcatgccgggcccaacttgggctcctcccaggcccacgctgctccgatattgatcctgggagaaagataaacagaaaagctggacattcagtcatgaatactaatgagccagggtaggggttttaattgctgtggacttcctttctccagttaatccttattgcaaacttcgctggagtcagctttctcgggcctcccgcctccttgtattttcctgtgaaatacccaggcgaaagagacccgtgacaacttgactttctcctcttcgagaggcccgtgtgagctcgagagcccacagcccgtgtttccagtgtgactctgtttactaattatggaaatatagggatcctataaaataaattgtttcaatatggctttggcgagtctgcttcttgacttcttcacccttattgtttcaaagacttcgtgtgtccttggc

SEQ ID NO: 981 - DNA, 500 bp, Homo sapiens; identical to SEQ ID NO: 775

SEQ ID NO: 982 - DNA, 500 bp, Homo sapiens
gcccccaccccgaaatggtcccgaggagagggattgcccagactgcactctacacacgatccctcttttctatatcaaaagaggaaacatttcagtctggagtgttccagaggtagttcggaggcagggaaccttttctctacagagcatgactttccccctttgtctgggacccctccctaatgttggtggttaaaggttctcatctactctgcactttcactgacacaggaaagatgatatccgggccgggagatgggactctcagaaacgaacgagttaggacacacactaatggccagataaaatcaattctaatattacatttgtagaattaaaaaaaaaaaaagaaactccaggttcttggagggtggtggctggaagaggtttcggaagctccacgccccttctcacaggccttgcattacgtatctcttcatctgtatcctttataatatcctttataataaacgataacggtaagaaataaaaatgaaaat

SEQ ID NO: 983 - DNA, 500 bp, Homo sapiens
ccctggttcagtgatatcccacgaagttcggggcggggaggaagtcactccaggatcagaggccgcgtcggttctgcttggggcatgggcagagggaggctgctggggccaagccccggctggacgcgagggaagaaactcgtcccaggacccgcacgcccatacctggctgtcccagagctcttccctaggccggcaccttcgctcttcctcttccccaccccctagcccttttgtctctttttcagacggatgttttcagtctcaagtggttttattttccgcacaaaaccctgagatcaagggcagatcacagactgtaccggaggctcgggtttccctggactctgtgctgttctgcgtcccagggttggctaggaaggaaggcctgggccggcgaggtgacgggtctcccgcccaggtcggcaggacggggggaggtgtgtcccggtaggtccctggtgagctcacccgtggcatcggggacccgcgggaaccca

SEQ ID NO: 984 - DNA, 500 bp, Homo sapiens
acgcctcacctggactccaccccagccctagggtggccggcgcctggccatccaggggaccaggcttgttgccacctccaggctcgccttgcccttcccagacccacagggaccacctaggccaggcctttattcccagaccccgaggctacttgggggtccggataagggtgtggtatacgggcttgacgatgaggtgcaggtgcagggcgttctcaaccaggtactcggagttgcgccgctgcaggtcggcgtgcgccaggaagtcgccggcctcctcgctgctctggtggaagctgtaggcgtggcggaccagcaggcggccctgctggcgcgcccccaccagcaccgtcttctggaagctcacgcccgccgcgtcgccgccgctgctggccggcgtcaccaccagccgcggtcggccgtcctccgggcgcgcggcgggcagagcagtgcccgcggcgtccgcgtaaacgggccgcaggctgacgggcagccagcgc

SEQ ID NO: 985 - DNA, 500 bp, Homo sapiens
attagtttccaatactagtacctttcaagtttccatttattttgactgtacccgtctgaaagcagatttcatttacgctagcaagactggaagccacaaataaagaaaaagaaacggattcattgaatctcagtatctcagtagcgtttaatagattcccttggctaaattcagagccctgtttgaattcactcacgcaggagttgttttgttttttttgttggtagaggtgccggtttcccatccccacggcttatttacaattatgggtgttgttatttttaaaggattcacaaggtgactaactctctgttatctgttgaatggaaggagtgttacatatgcaagaccgaatggggcaggccgagcccccgccctatgctattctacaatccagatgggattcgtgattagaaaataaaattggccaaagctgtctcggaatccttttcccacttctaatttcatcagcactattaatcagagctcaaaagagcaag

SEQ ID NO: 986 - DNA, 500 bp, Homo sapiens
gaccatttctccaggctgggggacgcaacctgcctcccgagaggcgcgtccctgtcgcctcaggcaggtgcaggccgggcgggcgcgtggggcggggcaggggcgttatctcctgaccgaagagggccgcacatctgtttatctctgaagcggcgctggattggatttctcgatgtttatctccctcagaggaacagcgcgctggggctgcggagagcgcagctgcgggccgggcagtgattgacaggtcgggaacagggcctcccgcccctcctccgtctgggtggggggcgcttggctgcccactgcgcaccccatcctagagcgctgcaggtgagcatgccggcggccaggtgcctccgagttcctcggttacccggcgctcaggcctgctcctcactagggaccacttagctgagccagagagattgcagtgttgacttagtgaggcagtctagggcgggggtggggagcgggagaggtagccagtgaaaaggtgg

SEQ ID NO: 987 - DNA, 500 bp, Homo sapiens
ggctccctgttcagctctcctctcctctcctctcttctccttggagcctactgataaattgacgccaggagcctgagcttcttagcaataaataagctccaaatatagaagaggggggaaaatatgatgagcctctctgacatttgtctttaaaataaaactagctgcacgtcaagtttgagcttaatttctggaaataggcggaagtcgctccggatcatgcatggaaggctaattgaaaagatcagtcggggcgcttgtggcagccttgtcactttgtgacagtgctccgctccgggaaattgcatcgtcacgacaaacgggaccgtgataaaacgaccctttccgtccttatttgtagatcactcagacgagattgaactgcacttgtttccccttcgaggggagccgcgttttcagggtagccgaaggcttggggctgagggggggccctcaccaaggcgcgggtgggggccggagcctcaactcgatgagaagtg

SEQ ID NO: 988 - DNA, 500 bp, Homo sapiens
cacctagtgttacctgggagccccaagccccagtcccccatccctcaggaaatccagttggaacccctactttgcagggccatctttggcctgaagccaccaggaaagctgtcccactgactgacccctcttaaggaagctgcagactgctgggcccattttcagatagaggaacggagagctgcggcagcccaggagccctgccaggcttccttctgggtgcagccacctgtgggtggggcgcggcctcgtctgagaccaaggcagggcccatgccttactcagctgtccttgctaagagtcccctagcatcttcctgatggtctttctgccttggggtgaagaggcatttgggggaattgccatcttgggaggaaaagcagtatcctttcactttcagactgaaaggctcctggggaacttgcttcactccggcgctttctgtcccatgctgaaggctggagtcgccagccccttcccctttgcctttctcaggcccc

SEQ ID NO: 989 - DNA, 500 bp, Homo sapiens
gctcccacttgaaagagacatagacctcagccacctcctctctgaggcaatttactcagcttctccaatcacacagttctttaacggggcagaaattgttgggttgtttttaatcaagtttggaagctgaatctctttcccctgatgactgtgcccaggggtggatccggctgaatgtctggcgctgcgggcagcgggcttggccacccgtttttcagacacaacaccagagaatggcactgaaataatcgcgtgtagcagaaatgtttaaaaacattaacctctcttattttctatacttgtgaattaaaaggcaaaagaagctgaaaggaaatctgaaatgatactcatttacctactgaaggcagaccaagaaactgtaaagatgcttgatgctttgaaaatgtactctgtaaaatctttcaaattagatgctgcttaagatcaatggcagtaaaaatatttttatggtttgattggttaaaacatttttagatatt

SEQ ID NO: 990 - DNA, 500 bp, Homo sapiens; identical to SEQ ID NO: 488

SEQ ID NO: 991 - DNA, 500 bp, Homo sapiens
gctgggacacgttgagcacgatgacgcaattcatgacaatgagcgtggcgaccaccatgacgaaaataaggaacctgaggagcccggaaggcatgacatcaccgttcctcctcccagctaccgaaggcgccgcgcgctgacctcacaaacacggcttctcctggtacgggctggttacgccctccagctgcgccccctacacgacgacagacgcgtcccccagcccttctcctgtcctaccacttgtggcggccatgaaggggacccccagctccctggacaccctgatgtggatctaccacttccacagctccaccgaggtgaggctacgcccgccaagggctgcacctcgagaccttctgggtaggtctcctgttcgcccctgtgacccctgccctgctactctactgctctgctccttctccaggtggccctccagcccccgcttctgtcttccctggaactctccgtggccgcagcccatgaatatctggagcaga

SEQ ID NO: 992 - DNA, 500 bp, Homo sapiens
ctgaaacctcctgggtgtaaggccatgaatctgctcgacttgctcacgggcgggaaggaaacaaggaaacaacgaaaagtttcctgcgaagtgaccaacatcccctattttttaaaaattccgtgtgagacctgagaacacactgtgaagcggggttcggagaacgacccctcccgcgttccgcgcccagcggggtcgcagggctgcgagcccggctgtagcaaagctttctcggccgcgtcctccctccggattcggtaggccaggctcgggcgcgcccttcccacaccaacaaaccatctttcccgactcagcagaggcccacaggggcgcagccgctgtccctccgcccttggcccagcggcgccgccctggtacgccaggcctgaaggcagggccggcccgcgccacgcagggtctcccttaggcggcgccttagggtgaaatgcggggccaagcctgacctgccggggtgccccgtggcatctctggtgcggacc

SEQ ID NO: 993 - DNA, 500 bp, Homo sapiens
cccgacttagatagcagccctcccaggaaaagacgtggctccctgttcagctctcctctcctctcctctcttctccttggagcctactgataaattgacgccaggagcctgagcttcttagcaataaataagctccaaatatagaagaggggggaaaatatgatgagcctctctgacatttgtctttaaaataaaactagctgcacgtcaagtttgagcttaatttctggaaataggcggaagtcgctccggatcatgcatggaaggctaattgaaaagatcagtcggggcgcttgtggcagccttgtcactttgtgacagtgctccgctccgggaaattgcatcgtcacgacaaacgggaccgtgataaaacgaccctttccgtccttatttgtagatcactcagacgagattgaactgcacttgtttccccttcgaggggagccgcgttttcagggtagccgaaggcttggggctgagggggggccctcaccaaggcg

SEQ ID NO: 994 - DNA, 500 bp, Homo sapiens
gagatattgttggatatttcaagcagatgtcaggtgggtgttggcggcctgtgagtcctcctgcagtagcagcagcagccaagtacggtttgataaatgctcaaggtgaaatgtggccttactcaaaaccccagggtgatttagggtagaagagcgaatattcagaggcgggaagtggtgagttatattgttacattccctttcgatggaactaaatgcggttatctgcggtcctaacctctctcgcatcggagtgcaatgtttctgaacaagctctgttagaactggaaaatgggagggggtgagggagcccactgacgacttaacggaatcttactgaagaaaatacaaagataaccgagatattcatgatattacatctcatgatcttccagacaagcgtctctccggaacaagaaaatattcccaaatttctccctagcagtggccttgggtggagtgagggaggaggtgggtggtgagtgtagagaagagaaggt

SEQ ID NO: 995 - DNA, 500 bp, Homo sapiens
ctgagactgagacaggagttagccaggaagctgcggggctgagagttttggacaccggcagtgtgatcccagagtccaggcacttaaccatcagggctccttctgctacgtgcattttgcagaggaggaaactgagtctcagagtggtgcaggggaagtcactggccaaggtcacggagcgctttttggcagatcaggaaggtcaagtccggtacgattcttccgcttgcagcttcgtgttgctcggtgcgcagggcaacgtcagagcacctctgactccagggaggtggaagcggcttccggggtgaatgcggttggatcgtgcgaggccgccaccactgccaagaaaagaaacacaccaccgcacaccttgccatccctgggtcaccacttccttcttcgtgtatgaagagcagcagacggaactcagcaatgtttttctaacacaagaaggatgactttccgaaatcgtttgaagtgggaagactggggcgagcggg

SEQ ID NO: 996 - DNA, 500 bp, Homo sapiens
tgcaggcgtgaaagagaatgatgccatgcgcctggccagaggaggcatgcgataaaggggcattccctgagccttcctcagaggacttggaaagagctctggacagggagccaggagatctgggttgtggccttcattctgccattgaacttggttgccatccttggacagtgcctgaggtccctttaaacagaagctccacaacaaatcctgctcaccctgcactttgcagcccggccacaaagcaagcggccacacccagggttgggtttggaactgttccaggtcacgcccttgtaaaatgagtaagcagagggcaggcctgcccacggggctgggccccgggcatctggggattgacaggagcgggagctctgggcctggcagggctttagggtggtctgctgcaaggagactcccctgcttcttcacttgtgacccaggcaagtgacttcctttctttgctcagtttccttatctgcaaggtgcctcattctgga

SEQ ID NO: 997 - DNA, 500 bp, Homo sapiens
agaaccgcagagctctacacagatactatctcactaatcctcaatggagctttctcaaagcgcctttatccagcctctctcctaggagaaagtgaggcacggcgggcagaggtggtgaagtcctcgcaaaagctggaaacatgaccccgggctcctgacgcatgggccattgtcctttgcactccaccgcgccaccttcctgtcaggtgtctggtaaacaggttaactgatcgctgattaggggcctcccgcctacgtgcaatgagtggcggaaaggagcttttccttgtcaatacgaaaatctttgagtacaaatcgataaagctagagattcaaagactgcctttataaaactggagaagatgcactctggccataggcggagggggcagcccggggcccctgtcaggaagccaagcggcccggggcatccctggaaggctgccgagggggcagcgccttctctggggacggcttcgtggagagtccgggacgggcga

SEQ ID NO: 998 - DNA, 500 bp, Homo sapiens
cggggaggaagtcactccaggatcagaggccgcgtcggttctgcttggggcatgggcagagggaggctgctggggccaagccccggctggacgcgagggaagaaactcgtcccaggacccgcacgcccatacctggctgtcccagagctcttccctaggccggcaccttcgctcttcctcttccccaccccctagcccttttgtctctttttcagacggatgttttcagtctcaagtggttttattttccgcacaaaaccctgagatcaagggcagatcacagactgtaccggaggctcgggtttccctggactctgtgctgttctgcgtcccagggttggctaggaaggaaggcctgggccggcgaggtgacgggtctcccgcccaggtcggcaggacggggggaggtgtgtcccggtaggtccctggtgagctcacccgtggcatcggggacccgcgggaacccaccgggcgcccactagagactcgggtcctaccct

SEQ ID NO: 999 - DNA, 500 bp, Homo sapiens
aaaagatgagggtgcataagttctctagtagggtgatgatataaaaagccaccggagcactccataaggcacaaactttcagagacagcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtaagcacatctttctgacctacagcgttttcctatgtctaaatgtgatccttagatagcaaagctattcttgatgctttggtaacaaacatcctttttattcagaaacagaatataatcttagcagtcaattaatgttaaattgaagatttagaaaaaactatatataacacttaggaaagtataaagtttgatcaatatagatattctgcttttataatttataccatgtagcatgcatatatttaacgtaaataagtaatttatagtatgtcc

SEQ ID NO: 1000 - DNA, 500 bp, Homo sapiens; identical to SEQ ID NO: 47

SEQ ID NO: 1001 - DNA, 500 bp, Homo sapiens
gcactctcctcagccccaggaaagcatgctgagcaccggaaagaaaaaacgttttgacacagtgccattaccaggactaacaaacattttcaggaaattcccttggtgcccataagccattacaaagctaccacccttgagtttgtctaagcacatgttgaagcaatttatgttttcagctcataaaacctcttggaataacaagttccactggttagtcatagtccataaatcacctcttcactaacacgacagcattcaggggaggcaatgagactagggggaaggagctcaggctctgtttatagatgtgggttgagtcttcgtttttctacttgtgaggtcttgagtaagtggcttacctctatgatcttcaggttcctcactataaagtaaggaaaatggtacctaagccaaaccttcttcaacctcaaaggctttgatctactgtttgtcctccctgctagattgctttcccatgcacatccacacggcttgct

SEQ ID NO: 1002 - DNA, 500 bp, Homo sapiens
ccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcgtcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggtgggatggctgggcaggggggtgggctgcgaatgccccctggggctat

SEQ ID NO: 1003 - DNA, 500 bp, Homo sapiens
gaagcaaagcgagggtatgggtgggagggagtgggaatccttggatttggcagagaacaagtaaattttcggaaatcatagtcagcgtggtctccacaaagatgagagggcaggaactcgattggaagggggccagtgaagctgctgtcaggaagctctcacagggcagtaaacagctcctggcacccggaataggaggaggaagtcgagaacccacagccgccctgcccagcctggctcctcctcacccgcccaggctgctgtgctcctcacgggaggaaaacccgcctgcgtccagctacctccaggaaagcaacaactgcccgtcctcgactaaaggccaaaccttttaacatttttgtccttgaccacggcatcagctgtgctgtctacagaaggaactatattattcccacttaaatagctcggtgtttcgtcaagagagtgcaaacacgagggcttcggtagagggaggagacactggctcaggaaccagagct

SEQ ID NO: 1004 - DNA, 500 bp, Homo sapiens
cttttcccccttccttatgaagccatgtggtcccaagcagacagagttcccttgctacacttaagggtgggcttctcagacctgagcatatcttaaaagctttcccttgactgtgccaatccaaactccaagtttcctcagcagatttaaggggttttaaatctacttgagcatgagtgttatgagaagactttgaaattcttacaaaaactgaaagtgaaatgaggaagacagattgagcaatccaatcggagggtaaatgccagcaaacctactgtacagtaggggtagagatgcagaaaggcagaaaggagaaaattcaggataactctcctgaggggtgagccaagccctgccatgtagtgcacgcaggacatcaacaaacacagataacaggaaatgatccattccctgtggtcacttattctaaaggccccaaccttcaaagttcaagtagtgatatggatgactccacagaaagggagcagtcacgccttact

SEQ ID NO: 1005 - DNA, 500 bp, Homo sapiens
gactttttatctcatggagagtccttttcaacatggttcaaaggagttggatggaagtgtaatctcactactcatcggttctagatctgccacttccaattagatctacagtaggggcgggggagaggagatcgggcagcgattctaacttttgcctttcggagatacagtggcggggcaggccaaacggcatctctgcagagagaagccgctaaataagcaccgtcctttaagtagaatttctccttccggtccagatcccagtccacagtccacatgtatgcctcagtttctttgactgatccacaattagaactgatccaataaaatattattttgaaatcaagaaatatctttgctttttatttactgatagaataatctttcacctttttatcgttttctcataaaccagtctacctctaagatgtcttatttgaaaaccataaaaactggcttttaaaaaagcgaatcccatccctttccagaggtttggtatc

SEQ ID NO: 1006 - DNA, 500 bp, Homo sapiens
ggaatcccggaagaaacgaagatttaaagaatttttttctaagtgattgagttccaataactttacaatgacttgactccctttttgtggagttaaaaaaaatcttcaaactcctgctagccatggcctttaagagaaagaaatgagtttaaaagtgagtttgaggcacagtcttgacccaggtgtggctttggtggtcctcagcgccatctcccccatgggcaccgaccccccaaggctgcaccacggcgggtggaccccaaagagagcccagactaattagaggcatcttatcagtcttgacttgaaattgaaagaaaattatgtttaaatatttatgactttgacatttacagtcaggcgtttttgaaaagcggaacacccccttctgtacagcggcagctcaatgactgaaagtttggaacagagaagaagtgaggaggaggaggagggagaaggaggcctggtaacacagcggcaggggtgcgtcccgggtgggg

SEQ ID NO: 1007 - DNA, 500 bp, Homo sapiens
acagcattcaagctcaacatggcaagttccctctttcctgcaggggaggaccagaagggagccggagatgggggagaagggtgggaggtggatggtttggaaaagggatggagacccagacggagagaagccagccagccagggtgagggaacaagctgctgtgctgcccaggagaggcctggcctcaggctgccagcctcagggaggtagatgcggctgtgacagcagcaaagaatgacggccaagggcgacagcaggggctggccatgctgtaaaggggcttcttgggagggtccagcctcaggaatcaaggggaactcctgagccgagaattctgaagatctcctccctccctgaagctgtgggctgggccatcggaaaactttcagttttgtttccttgcctgcaagaaacgaaactcaaccgaaagcctgcagagagcagaacatggaaggagacttctcggtgtgcaggaactggtaagaaagtgctttctcca

SEQ ID NO: 1008 - DNA, 500 bp, Homo sapiens
gaaaaatcctctctctcaaagtttttaaaaagaaagtgctttggagtcttctaattctgaacaagaattttctccttaactggaaatcaagaatgtttgaattcacttaatatatagaggaaagaaagtacaaagaggaaggccacacagccctgtggtttctgtttatctgttttctctcacatgctgtcgtttctgattcagcggagacgggggatcctgtgtcagagccgtggatcgcagaggcagcgaggctcggtctgcaaacaagacgctgcaaggctgagtgagagagagagggtgtgcgagcagcgagcacatgttacatcagacacagtacctgatttttcactgcacagcttgtcagctagatagtgtgtctcctgggcgataagtgaggatatttcatcttcatactcttctattatagtttcacactgtagaaacataataacaacatatgtggatagacgcacactggcggggcactttgttaggaa

SEQ ID NO: 1009 - DNA, 500 bp, Homo sapiens; identical to SEQ ID NO: 486

SEQ ID NO: 1010 - DNA, 500 bp, Homo sapiens
ataggcataggactctgtaactgaaactcagagaagctggcaggagctcccttcactcccttacccggcacccacaaggcctgtggcttccccgtggtgagcctgggctctgtgcgttcttgcctcagcacagacatcctggagggcggccatgctggggcccgcaggggcgtgtggcttgcgtatgtttccacttggccttgacttgtcttttcggatatttatcacacggtggagacccattgtgtccgggagtggaaatcagggaggcaggacgttagtggtgtttcctgaaactggttctttaaagggaaggggaatttcccttacataagcccgcagcgactttctccacagggtggggcatcctgtgttctggagtctgggcgctgggcgggaacctgggagctttctccagtggagctgaggccaagtcttggctcacaacatttctcccggggaatctgctccatcttcggtcatcatttacgtttctccgt

SEQ ID NO: 1011 - DNA, 500 bp, Homo sapiens
tgcaggtgagggcacaggcagcaggaggagggctcaggatgcagcagacctgacctgacacctctaccgcgggaggcaggtgggaactcaaaggcaaggcggggcggggctgggaggagagagcaggccccagggaggccagaggtcagaggggcagacagcacgaggagtcgcaacaggctgtcgagttcccggttcctggtggagagcccggcaggctgtttgttctcggacgtgtgcaaccgctgccggcggggctgtgggcgccgcagcgtggaaggaaggggtgggaaggggtgcattctggaccctcgcattgattggaccaaatggacaaaagccaattatttttctctgagtaaagcaaggtacggaggctggccatcaaaatattaaacagacatcgcttcttggtcttttggctgagatcaagtgtaaaatattaaacacaaataactaaatctgaagagaagtctttcacaatgcttgttaaacaagaa

SEQ ID NO: 1012 - DNA, 500 bp, Homo sapiens; identical to SEQ ID NO: 808

SEQ ID NO: 1013 - DNA, 500 bp, Homo sapiens
aaaaaaaaaaaaagaaagaaaatgttttgagtgttagcatatttaatatattaagctctaaagaacttcaaatttcagatagactattctcaaagtaacaaaaatatctatgtatgtaatttaaataaattaggagccaaacatacaattatagtgaagaaaaaatccacaaagtctaaaaattccttgaaatccgaatcaactgtggggctgtggaatactaacactacaagctctcgagacgctcttcggctgcctgaaagctggatttcttctttgtcaccatcagaaaaggcaaaggttattcagtgctctgcacatcctttaatcagccagacatcttagtcaaaatcatttttaaaaacttaatcctttcaagagtggtgctctggggtttttttggttttttacttttatttcctgttttgcaagatgtaaaaccacatctagaaacatggtggatactaacaaagcttgatttcttaagagaaaaataaggt

SEQ ID NO: 1014 - DNA, 500 bp, Homo sapiens
aatttttacaagttactacaatagaactgttttattaaacatatgactgtatttattttgtacaaaatgcagtaacacttcttcttttcctctgcccctggaggcactaccgcagaacttcatgttcacagaaacacacgtcatggcaagtgtgtcaaaaagtcatgacaagcaggaaagtgcaattctgaaagtaatgccacacaaccaaagtgggaaatgaaaacaggcagaggccagcaggtttctcggctagggctctgcctataacgccctggtcctgctcatctttcagcagtaaacattttaagaagagaaactcctgagcactatgtaagtactctcctggtagcatccttccaattccatctatcttgatgttgtaacaagcttatttgtaacttcctcaagaaatcccaccctggattgcatccctgtcaattgcccatctccctctgagcttcaaacaaaacaaaataaaacagaagagcagtaagttt

SEQ ID NO: 1015 - DNA, 500 bp, Homo sapiens
ataagtgttggataaaatatttgtcttctcttcaataattggaatatttgtagtggcctataacttcccctctgtaaaactgtggtcaaaaccctcagggagaggagaaggtaaaggaggagcaaaagagaggaaatgagagctcattgttttgtaagggaggaatgaaatgatacatgtatggttccttaatacgcagtgcactgccttttctgtctgtcggtgagttgcagtggcttgtgaaccagccgtgcatctcttccaacagaaaggctaaaaatgaaagggtaactagctttgatgttaaatgccaaggaaaagttaatggccaagaggggactaggagtggagataaatgcaagttaagatttcattttttcaaaactttttttcccttcacgtatattataaagtaaaaaatgccttcttagtcaaattgtaaactgtaatgcagtggctcctgacaccaaaatcaggaagcttttatttaatattaaaag

SEQ ID NO: 1016 - DNA, 500 bp, Homo sapiens
agaaaggaagaaaaaagaaaagaaagcaattcctactccctggcctgcagcagcaagtctcccaaagcagggatctcaaaggagcaggctgtttacatggggggagttgggggcagtagagacaaaaatataaggataacagaaaatgaatcgtcgtatctcagagacggcccctctaaagaggtgacttccaggggctcccaacaagacacctgcaccccctccaccttctacccctaccccatcacccgcaggcagaggaagcagcaaaccacatagtgacatttcaggactaacaaaaagccctccaggaagtaaatcaatctcccccaagcttcctgaacacctacactctccttcatctaaggcagatgtcctgaagaggtctctgctgaaagggatcagttgacttatcactgtcaccttgctgaggccagggcaacagggaagataagtgttgactgggaagcaatacttatccaagaaagaaatgggtattt

SEQ ID NO: 1017 - DNA, 500 bp, Homo sapiens
ttctagagttattcttggccctgagcaccactagcatggtgggtgtttctggctgaatctgtctggttgtcctcatgctgcacactctgacgggtgacctgaggccatgagtcagcattgtggtaacattccttctcattacaccagccattctgcttgagtagtcctcagaaaagggaaccattttttaggtaggaaaacaagcttctcgttgtggtctataacctcttctctcctctgggttcagggcgggagagttacaatgcccagagaagggcatgcctcttccagccccctaatacatataaccacatttgattctcatcataaccctgcaatgttgttcccagcaagatggtctgtcacagaatccttgtatgtgtatgtccttgtaggtcaaggcttcttagctttctgccatttgacaattctccctttgtatggggaacgagtgaacttgacatgacctgaatacacagaatcccaaggcttggaccatt

SEQ ID NO: 1018 - DNA, 500 bp, Homo sapiens
tctgcactaaaattactcaccaaaaccaatagcagggtcctcactgctgttactgaaaatgattaacctttgatacacttgtaatatctgagaaaaagaaatgcaggggtctcagcagggctcccttctaaggtcacttgatttctaaagaagtaaccactaggtttgaagtcatcaggatgttaactatggggatggttggttcagtacccaacatcctgacagcacatctgaccatgtatattgtatcggagaccacatcctcagctcagaaaaagagctgaactcatttcaaatagaaagcacactgcatactgttcctccagggactgaggttgactcttcttagagtgagacattccccaacattggaacaaaaatgactcccacttcttttctcacctaaacctgttcagaagaaagtaaggaagaaaggcaggaagcaggggtcgggggggggcggggagggagggaaactcggagatactttcagtatctaa

SEQ ID NO: 1019 - DNA, 500 bp, Homo sapiens
caatttctctgatctgcataacagcataacaacttgcaaggcagatgttattctcttgattgaaagaaatgtagctaaataataactttactcgctttcccaaggtcacccaaccagaggctataaattgaggtttaaaaaagtttttgctaaatatctcatagtccccgtatgtccataatacttaatgcaataatggatgatgccattacagcacaactgcagtcagaaagaaagagcgaaatgttgcggtttagttaatgctttggaaaaaatgtttttaaaactggcctccacccagtttcctgtgttcaacttgctgatactgttacttcagttggttcatcatcttagtgatcctcttaaatacattttgtacagagtgcatagccctttaatccatttttattctttaagcagtctcattttggcatttaaagagtcagtatcaattattcctaaaattctgcctctttatctaatataatgttcctctttcc

SEQ ID NO: 1020 - DNA, 500 bp, Homo sapiens
acctctatgagcctcagtttcctcactgaacaataggaatggtaacatcagagggttggtgtgagaacaaaatgaaattatacatgtaaagtacctagaatattgcttgccttacactaggggcttaatgctaattctctcttatttctatgtaataagaaaaggaggaacaattgacatctttaggtagaaaatttggactaacagatggcctcaagaaagcgagagctatatggttgcgtgatttttcgaggaatcaaagaggaagtactagaatcctgaagaattcataaggcagaaatgagatttaactacctcttgccatagctaatgtggattccaaaaaaagaagccttgaacactctactccagccgtaacctcaggagtttcctctgggtagtagtggtttgttacttacttaacatgaagagacttaagtatgaagccaaaaagtaaagactcctagacctaaggcatgccatctgcctagcattaagca

SEQ ID NO: 1021 - DNA, 500 bp, Homo sapiens
gtggaaaacaaaactacactcagtctgagtggaggagtgcttgaactgtaagtccttctgtacaggaaaggagttacacacccctccaggaggccacccctacccccaagcagtttgttttggtccgaaaatgacaaaggagactggacttcagccatatggctgctggtttggggcagacctgttcacagtagaaccataagaggttatgacttcccttgtggtcaccaggaggctgggctgagccggcgtaaatgatggcacttgctagggtcacagaaatgcatctttaagtgcattcaattacagacctacccatacactgcgtttctgacatgaccctgaagattccatagcacatttctggaaggcttatctgagagttgcaggcaggatccagctcattgtggctttatctacacaaggcagatgaggacaaggttgttaccatctcccatctgtggctactgatgcctggttaaataattgttccaagtccc

SEQ ID NO: 1022 - DNA, 500 bp, Homo sapiens
cttttgtatgtagaatgttctttgtagacattctgggcctttgcaagttgtctcaataccacattgccaaaccttagaggcagagtcatggatgtctcctaattaagttatctgaagcccacatcctctgcctgtcttcagttagatgcctagtgtactcatgggaggggacagatgacaagagtttcagggccaggctttgatgtctgcatcgtgccatttccagaaacccaaggttttcagtcctatcggttatgtgctattccctctaccaaatttataatcttaggtatatttattgtattttttaaaagacttctctctttgtaagcattatttttctagatttggcttttttagttacggtgtaacgtaaatttttagtctgaatctgctaaagttatgatgcttgtggatatcaattattttgagaccaagtaaatctcaatgacatttgaataaaatgtccagcatacctttgcacaggcttgttttgcttg

SEQ ID NO: 1023 - DNA, 500 bp, Homo sapiens
aaaaggccataaggattttgtccccaaatttcacatgagctaccttgcttcaaactactgagatgaagggggcaagattatttgtccttctttctagtttatggagtgggggcattgggcttaacaacagtaagcattcttggactatacctgaggatgggaactctcagaagactatgccttctgcttcagttcctccaaataaaatacaaagtttgcaaatactgccaaccactcgggtcatgtcggcggagatagctacaactccagaggcaagaacttctgaagacagtcttcttaaatcaacactgcctccctcagaaacaagtgcacctgctgagggtgtgagaaatcaaactctcacatccacagagaaagcagaaggagtggtcaagttacagaatcttaccctcccaaccaacgctagcatcaagttcaatcctggagcagaatcagtggtcctttccaattctacactgaaatttcttcagagctttgcc

SEQ ID NO: 1024 - DNA, 500 bp, Homo sapiens
tccaagataattttacagaaggagaaataaaaacaccagaatatattgccttttgaagtttggcacaaggccattaaatattttatatacagggtatcactttttaaactttattgatatatgatgaccatttccttagacttagccagtcaatctttgtggctgctaaatttcccaccacatcactctgcatcgacaagattcagtttcctcctcctccctccctcctaaaatatacaggcatcttgtcgccacagaactcagcacctaggaaaccacataagccactacagaaacgattgcattctagtgccttccgcttcataaagaaagatgaaaagggccaaacatttattcagtttggctaaaggatgactaaaagtggtggggaaaatcattattgcctgcaagtatttgtatcattgtgaagacaaattgccccagtagaattatacacatattaaagacagaaaatatcatggttataaaaccacatgcat

SEQ ID NO: 1025 - DNA, 500 bp, Homo sapiens
gggtgagtaggagcagaaccccagcccctgctttactcctgaagctatgctccctggcgtagtgctatgtctgcctggaggaaggagctcatttaaaaaattttcaacaacttaccttacgggctttcagtagccttgtgatctttgggaaggtcacagcaaaacgaaaacaatgaaaaacccaaaaagcaaaaaacagaaaacaaagcatgacatttagtcagatgcagatcctgaatttaagacttacgctacagaggaactcctgagtttgtttgtggtcttgagtgaaaaaaaaatttgcatttcctctgacagttcctcattctctttcctctagcttttgcagcatttgtttagataaactttgctgaggagatcaaatcactttgcttataacagaaatgatattgtagtttcaacatatttatacagatttatatgtgtgccaaaatatgtttacatatgtagaaacatgaaggtacagaaatgcctttatc

SEQ ID NO: 1026 - DNA, 500 bp, Homo sapiens
taaaccttcaacagtttttccttctgtttcttcaaatcatatatggtggtcattccaatcccatactcttttgtaagattttcacacttatactgctgtccaacttctctaaggttgactttctgtgccacagataaacataaatgcttcctctttttcttatcactgttacccaaaggggtatctgcaggccttttcgacattttcagcaatatctgtataccacaaagcagagaataatcaaaaaaccgcagaaggccaggcacagtggctcatgcctgtaatcccaacactttgggaggacaaggaaggagtattgcttgagaccaggagttcgaggccaggagttcaagaccagcctgggcgacagagcaagatgctgtcccaaaaacaaaacaaaacaaaaaccactgtaaacaatctgaatgttaactgtaaagaaaatggataaattgaaatatattcatacaacaataaaaatcaatgaaatacagatcata

SEQ ID NO: 1027 - DNA, 500 bp, Homo sapiens
taaggtctggaaagattcagttgcttgttcaaaagttgaagagctagcaaatggaagcccacaccatgtatacagcccacacaccctgattctaaagcccacaccctgtgtacaatgccaaagaacccttaggatatgtgagtgggtcgacctagcttaagttgcttcattaagccaaatacatcaaaaccctccctacatcaggctgagatcacttgcaaactttatcctgagcacctggagagcttgcgacatggtccttacagcaggaagaatttaaaagaagataactttgggggaatgcttgttgtttttctgaccatttttggatgcttgatccgttaggtgaggaagaggagagcttagagttgaagtagatgatgggagtttcgacattttcttctaattaaaactgtaatcttttataacagaagcaaccattctggtttttcaagcatttccaaaaaccattttctcaagaaagagtgctcataatgtat

SEQ ID NO: 1028 - DNA, 500 bp, Homo sapiens
gtatctgtgaggaaggtattaaactcctcaatgactgagggagcatgagttcaggaagtcagatggtcatagggagagagcaggagagtaattctcaagccaaaaaagatgatgatggaagtggcaataaaccacatctgggcccaataattcaaggactgtaatagaaacctcaattcaaaaagataagcctgagaaataggggaccagagtgtacaatttaacagtgtgacaggaagggatgagatgcgaagaacagtcatggtggaggaagtgaaatgtagaccacagctagtaaacagaaagactggaccgcagactaagtcttctaactcccaattcagggtcactgacaatttcaactcatttttccaggagactaggctgactaccctgctacatacagaagtgccacatgatctttaacgaccctctactacatcttaagacttcacttagagttacaaaaacttcaaacatttcagagcatcatttgcgct

SEQ ID NO: 1029 - DNA, 500 bp, Homo sapiens
atcagcctatctcaaaattagtgatatttagaacttcacctagcaattctagaaagcttttggcttgcaaggtatctatgaaagaaagagtggaagttttgcacccctttcatctaatcaaaattcaaaatttcttcccccttctattgttattcatttatgagcacagatgtgcaaaaaccaattcattttaaagtcaaatactaaatatgatgacttacatctgtacaaaaatctgaagtgcagtaccgatactaatgcggtgacatcagcaaggccaaacaggaagctgaggtatagcccccatcacacacagacactctctctcggtctctctctctctctctctcacacacacacacccctacacacaaacacacacacacacacaccccaaaagtgtctcagctataatattgcattcacttaacgaatagccttattgcaaaactttgtggtttgtgactagggtctattgtgccaggaaaaatatctccctc

SEQ ID NO: 1030 - DNA, 500 bp, Homo sapiens
ctgctctgtgagctgctcagcccctctcacctcctattgcttgcaggggctgtgatcaaggttgcaagaggatcagtagggactgagtctcctcattgagacttgtaacaacttcgcatttgacaagcgaggaaacaggaagtagggggcttagatggaaacatggggcgggggatggtatatttaagacttcaaagggcaagtatttttgccaattcaggttccccagtgactgaagatgttgaaatgcgtttcctgtgttgctccttttctgtgttgaccagctctgtaactcatgacacctgcagtctgctgcagagctctgcatcctgacaatcagaacaaaccatgcatctcacagtcctacagtagaaagctagggtcaattagttaccaaaattgatacttattatggggagaatttataacagaatagatggcaagccatttttacaactctggctatgcccttggattgcacaggcaagattaggaaatta

SEQ ID NO: 1031 - DNA, 500 bp, Homo sapiens
gatgacatcactgactacagaaccctttgtataagcatcaaaggggtagcagtggggtaaatgatcacatcctggctaaatggttccgattcctacaaccctgcagcacgcccccccggctctaaaccttttagtcatttcctgtgaatcttgccagcactcatttcattttttgttttttccattttcttcatctttcccacatagtatagaccagaatgaatcaaggtctaacttatgctgactgtccgtgttgcatcatcagtctttggggccccttctcagtttctgtggctgctcttgtgcctgctgactccatccctgtagaccttgctgttcctcccagtctgtggccactaacctcagttatttttactgaatgtgttacctcatccatagtgagtcttttgttgttgttgggttttttttttagcaacaatgtattttttaattaaggtatgtacattgttattttagacataatgctattgcacacttaa

SEQ ID NO: 1032 - DNA, 500 bp, Homo sapiens
taaaaatctgcattttattgtatgtaaattatacttaaaaagtagcagtactggaagaaacacaaaaacagtttttcgatgaatgcctatcttcatccttgggaggctcagctgtgggcctggcttcctatgtcacagccttccctgcatgtttacggaccatggcaggttcttctgctggccccctctggtactcagaggggttcaggcaggaaacagatgcttttgaatacttactgccccacttttcgtgctctttgaaggacgcaagaaaaaggagtcaatctttacatgcttcccaattacaaaaagtagctaggatggcaacaatctgtcttgacttcccctgtgtttacatcctccaacccagacctgagaaatgactgtgaaattctgaccaagactcactgttttggcagcttccttttcctttatttgctccccatccaaaattctcctccctcttagggatgtctaatttatacaatttgtctagcagg

SEQ ID NO: 1033 - DNA, 500 bp, Homo sapiens
gacttggcaacatggaggttattggtgacagtaacggttccagtgaaaagatggacaagggtgttgatttattgaatgaatataacacatgttatgagacaagatttattaaatgtttattatgttcacaggatatatctgtacttctttcatatttgagagggcaggtaatctatattcccagttcctagatcgatgcctgccacacagttgtgcatagtgcatacttttttaatgaatgaatcacatcgtatcatttttctaaatgcaagcatcacttacctaacagtatcaaattttaaacaggaaattagattataatctttcccctaattcaactgcctcttttactactcagtatgccgtggctaaggagattaccacacagctaagcctgggaccaaaacccaaacctctgaagttgagttcctcattttgtctgctacaacttttgctttatgtaactttatgaacctcagatcacctttggttcaaagtag

SEQ ID NO: 1034 - DNA, 500 bp, Homo sapiens
actatagaaacatgatgttataaataacaatagtgctgaggaagatgaattagtgtaaaattgtattttttgttctgaggataggttacatagatgattctaatccatttattatttttacattccaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttct

SEQ ID NO: 1035 - DNA, 500 bp, Homo sapiens
agattttcttatcactcctggctaaacattttcttaatttattatgcgcttgatcagttggtaaactattgggataattcctagtcgtggtgtcagctggggcttgggagcctgaccattatctctgtgggtgccctggtgccctgtgggctcaaaccacaaacagctggagtccactgagaagaaaagtactaaagctttttctacctccaaaggtgtttcctgcttaccaggacttgtaaggctcagcgacattcagaattcctcttttcttcagcagaaagtttcatttactgctgtgaccctcgacctcttcaaatgagtttaaaatactttcttacactgaggtaattttttgtcttttgccttaaatgtacccaggatcctatgaaatcctaccaatacacagagagaccatggtttgtgtggcccagatgacagcttcctaaaactcacctgtcatcctttccatttagacttccttttttcaaataccaatt

SEQ ID NO: 1036 - DNA, 500 bp, Homo sapiens
agaccaagaaggtaaaagtatacccacaacaaaagtgcttacctgagtttctcagccttcaattctttctataatggaagaagttcaactcacccaaagagcagtcctttctggtggacagttaggcttcaagcaggagacatcctgctcttatgtatcctattatagtccactgaaagaataagaaactcccccattacccaatcccagccacttccttcaccacctccggtcctactcattttgcttcggctagtgaaatctaggcttctctgttgaaagtcccccgctacttacctcagagtggtttcactcttcctttctccttcctgaaacccaaactctgttttcttcccctctttgcatggcagaactcatctgtaagatcattgccaagaattgctagggcacggagtcagagcatcagaacatttgggccactcctcaaagggccaaaagataagaccaagttccaggagcaactttaggtacccccagaa

SEQ ID NO: 1037 - DNA, 500 bp, Homo sapiens
ataactgctttactgggttgttgggaggactaaatgagatatcataagcaaagcatccccctttgtctgacctatgggagtgctctgtgaaggtttcttctcctgcccttctcctcttgagtatttgaccctgactggttcataaccttccgtggctgaagttcatggtcctgatgcctcatttagagatgaactagctaaactctttgaggggcatggtgatctttattctgatgatcttcaccccaacggtgcctgtccttagcaggcaccaagtaaaggtttgacaagtgaacaaatgctactctgaaagctgctaggattctgtgtcgtagcccacttctccttttgaagttgcattttgggaacagcaaaatttaaccacagtataataaggaaggcataattcactattttgcgagactcaaaaactgctatcccagcttatctaatgaaagatagtccaaatttcctctcaatccaggctgagcttccatgtg

SEQ ID NO: 1038 - DNA, 500 bp, Homo sapiens
tacatcatgagaatgaaaaacaatacccattggtaaacatatgcaaaggttacaaagacagtaaattaaagactagaaaatgataaaatcttggactatcagttataccatactagtaaaccaggaagggagcataaaacttactttcactagccacatgattagctggaaaataaccttcctgtccctttcctatgctgccataccaccagtcttcattatctttgaaaaacactcggataatgtctccgcgatggatggttagttcatctgatcgattcgctgtgtagtcataaagagccactacctaagagagagataagaccaccacagctttatcacaactgtaccacagagaaaacccccaacattcacttcctcttgcagaagagcagctgaaaccaaagcagtactttggtaagtgtgaggctgtctcaaggtttgctaatgggatgaggggtggtgggaacacagcaggagaagcaagataaaagactgtg

SEQ ID NO: 1039 - DNA, 500 bp, Homo sapiens
agaaagggagggaggaaaggaaagagagcttgaggtatgtctttgagttgcttttgggctgcctggtggcaccttgttctagttggggacctgatcaggtctgtggcctgatggcatggctcctcagtgaaagcaatgatagggagctcatgtgaacttgtctatttccactaaacccttttcatgtacttcatgtgctttcatgtatagaccaacagcaaagcctttactgccaagacttcctgtgtgcggcgccgctaccgtgagttcgtgtggctgagaaagcagctacagagaaatgctggtttggtgtgagtttgctcttgcttccttcttgggtctgtgactggctttttgggtgcttatgtaggaactggagttgacaatgaagagaacttgcaacataccaggcactaaggaaattgggaaatatgttgtttctttttttgttttttgggtttttttttttttttgatgtagggtcttgctttgttacagag

SEQ ID NO: 1040 - DNA, 500 bp, Homo sapiens
ctcaacggggcagccagtcacccatcagaatatcctcaaggaggccaggtgtggtggctcacgcctgtaatcccagcactttgggaggccgggtcacctgaggtgacatcacccagtccttggggtctatgcatcatttgacagagaatttcctcctgtggtctactctttgatgtcagtgggttaagaaacttctgcctaaaggtgttgtctttctctgatgagaagaggaattaggggaagtaaccccggtcttcagagtgtggtctacagtccagcaacatctgcactgcctgggagctctttaagaagacagaatcagggacaccaccctagatctgctgaatcacagtctgcatgttcatgagaccccccacccccaggtgattcatgtgcaaattaaagtttgagaaatagctctttagagtaccatataggagcaaacaacactcttcctccagagagagaaagtatggtcatattaaaatcccgggtgtggg

SEQ ID NO: 1041 - DNA, 500 bp, Homo sapiens
tactcagccgtaaaagtttatttttgattcaaatgcagagattgagttttgaaacaaatctagattagtaaacatctatacttatatatagatttataaaatataaccagattatctaaaacttataaatgcatcttaaaattttttctttcttttacaggcaggaatttatacgtgcatgtttaaaggcgatacttttcaaatgccagacttcctcagcttgtgctatacttcccgttcacacactgccgtgtctttgctatgccctcccatacaccaaaaaaaaaaaaaaaaaaaaaaaccccaaataatccaaaaactcttgttcagatttccaaactggttcaaggtcaagatggaccaaaatttactttggctttatcttaaccaaagtcttcccaatcagtttcctaatatgtaaatgacatttttggtaaaagatgagcaaacatttcagaaatgagccaacaatttttttcttatccccatcataactttta

SEQ ID NO: 1042 - DNA, 500 bp, Homo sapiens
tggagaggaatttgcctgatgggtgctcttggcttgtgcccagaggcctgggtgcctggccaggctgtgtggggaggtcaggatggccccatgttgggtgtgggcctggagtcctgcttgcagctggggcccttcccttctggggctggcagtaaagggcaggagggactgcaactgaggcactgccccctggccactcccacctccgggacagggcagatgaagtgtggggacctggagccatggggtcgctcaggccttatgcctgccatttgcaggacagaggatctccggggggatgtggccatgtggtctgatgttgggctgggcagaggggaggggtgacattcccagcaggcagggctggcacatactaaccctggaaagccacggatgtggtgggcatgattcacagtgacatctggggctgactggcagagagctgggtgagacgggtagaagcaggtgctctcagggctacctctgcctttttcctggga

SEQ ID NO: 1043 - DNA, 500 bp, Homo sapiens
taagtttatatgttctcagaaaattggtctttgaataattgaggacagtgtgggtttttattctgtttctggaaggcggtgcctgtggctgtgagaaataaggaacagaccatcttcccacatttgagagggaactatacaaaaatgggaaaatatttgttttaaatatcttttggatgtgaattttgtcataattgcaaactgttttggcagcaaaacgaattatttcggtagcaagaagagacttaacgatgctatgtgggagaaaaactaagtccctactatctttctgagagcacgtctcagaggacatgatgtgatcctgtaagtttgtagcaatcttattgtgccccagtgcagacactccttcctacttccctgtagaaaacagaactgtttttttaaaattctttctcaactaccatttttaatagtcatgttacttgatgacaaaatctgatacagtggcctttaatactatatagtgaatgatttttgaa

SEQ ID NO: 1044 - DNA, 500 bp, Homo sapiens
ttgctttgttcaattccttaccacaaagaccacaagactgagatatgttctgacacagccctgtaagaatgctgcactaagaaggtgcttcctcctccatgctccctaggaccactgcacatgccttcactaaagcagttatctcgtggctgcaatgtgcctttacttttacgagtgcctccactaccaagatggaaacccctccagagcagggactatgctctacgcttggcatctccagaagcccagcgtgaggaggcacctcacccacccatcaggaacttgaagtgtttccaatagcaaatccccttgttcaatatgcagggtttctagctggacttatgatttgctgcgcattatagtgactttatcaacctcaggtggaagtaggcttttaatgaaaatatgaaagaactattcatttattcatgcagcattattctatatactgcacaatgtttaacacttctgaactcagggaagaatgccaggagcattct

SEQ ID NO: 1045 - DNA, 500 bp, Homo sapiens
agcacaagaaggctctgagggcctgtgagccataatgactgatttcacccatgagccaattgcagaggcaacagaagaccagtgcaccaaccaggctgggtccctccgccagagggtgtcaccatctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaaggtaagcatgaacaatgggactagtactgattattccaacaataatagggcagggaaccctgaggcggcaggtgcagcagttagactcccacctttttttccactgcttttccactgactataatctacataatcactcagattatacaggccagccagttcaggaaggcagaagtggaggcttcttttcaaggcttcccctttctagat

SEQ ID NO: 1046 - DNA, 500 bp, Homo sapiens
attatagtccactgaaagaataagaaactcccccattacccaatcccagccacttccttcaccacctccggtcctactcattttgcttcggctagtgaaatctaggcttctctgttgaaagtcccccgctacttacctcagagtggtttcactcttcctttctccttcctgaaacccaaactctgttttcttcccctctttgcatggcagaactcatctgtaagatcattgccaagaattgctagggcacggagtcagagcatcagaacatttgggccactcctcaaagggccaaaagataagaccaagttccaggagcaactttaggtacccccagaagccttgggtttgtttcagaggagcactacctttcttgtctccacggcttagacatggttcaagtcagagggacccatgtgacaccctagcacatttgagaaaccaagtcagatgaagaaaagtggggaatgaggcatccagaattctggtttcattctcct

SEQ ID NO: 1047 - DNA, 500 bp, Homo sapiens
gtagagaggctgacagggactctagtaggccaagcctgccttgtccagagcgggacaggtgggaccccagtgtagtctgccctgccctgcccctgctctctgtccctggggccccagccagccaggcagaggggtctgagggctcccatcaatccagccacaaaacttccctttctacctctgcccttctgggctgtccagggtccatctcctctcccgagaggtccctggactcaccaaggcagtgcccgctacagcatgtgtacgagaagccctgctgtcctagcaggaaggagcaagaggacaaatcgaggggaaggctgtgggttctgtgggcaagtctgcctgctttgtgacactgagcccagtggttgctaggttaccctgttcccacaactccagaacctctgcccagcacccctctaccacatcccctgcctatctccccctcctggaagggtagacaagggctaaggaccttctgtccctcctgacttccc

SEQ ID NO: 1048 - DNA, 500 bp, Homo sapiens
tattcaagtcagattgtttccagataatcattgaggtactggcatgtaacacacattaaataatctcatctgctaacagagagtaagtgcatttttacatgttttagagattagaattggatccaaatgaggtgtaacgtaatggcaccatgagatctgtggtggggaagggtgatggggagaaaagcttcagcaaaaagaggactaaagtagaaatatcaaccgccagctttcatctgtgcctgggggcggtccttcctgtgctcgtggcacgtgtttatactatgattgacaacccttaaggagaaaggctaaggtcatgaaacaaagctctctttccttttcttttccctccccctacctttaccccattcctttctttttctgtaaaagctagctgtgatgtgtaaatgttgcacctgtcaccctgacctcattgtagagccatcttctgagtaactggcaactggcaactgatgctaagtgctatgaatgcagct

SEQ ID NO: 1049 - DNA, 500 bp, Homo sapiens
gggacgaagaatggcagaaagtgaatgaactaagcgccaaactggagaatttagaaaaataatgaaattaaccccccaaaaggaaagataaatgtaaaagtgggaattggtgaaaaaaataggactaaaacaaaaatccaaaagttggttcttggaaaagattaattaaatggatgaacttttggcaaggttcaatgggaaaaagagaagtcttaaataaaggaacttaacaagacaggcacacaagagcgtaaccttgtgttacactcaggaaacggagagaagccaccacaggaaacggaagaagccacctctgtttctggaggagactggtaccatctcagacctactagcccttgggggaccccaagagaggggacacccatctcctgcaatattttggggagccaagcttgtacctgcaaacacacagagcccaggcctccagaaaagtgtctgcatcctccctgaaggagccccaggccagcagccccttcctg

SEQ ID NO: 1050 - DNA, 500 bp, Homo sapiens
tacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcagggagacatagctagttgtgtga

SEQ ID NO: 1051 - DNA, 500 bp, Homo sapiens
gatcccagctgtcaggacctggcttccagatctgaattctagagcagagggagggaaggcagaacacctaccagcacactaatgtttcaagtttggcctagagcaaagagcctgagttgctgttggccaaacgttggcctgtgtttgtcagactgggctgaagacttcctccctggtctatccttcacctcttatgccacagttttgggaaacactgtgctcagcaagctgaactgcttcttgggtgtgcgactagggtgccagccaggccagggacgtccaggactggaagaaatgcaggggcaggaccacagcacaggctgatcaggaggctgccccaccaggagctctgctgaaggctgcatcctctctgctgagagtcaaccactgtgctgactcaccatccttgtggttgagaacccatcagcaaattggtggctctgatgagccctggagctgcaaaatataggccggggtacctcagccggaagggacttcag

SEQ ID NO: 1052 - DNA, 500 bp, Homo sapiens
ttatcccaagagcaatttggtctcggaaaattggacccccatagtcagttaaatagtgtatgtaactaccctgagagggtcacatacaggactcaccagaaattcattggcaaactcctctttagtaattttcttgctttgggcctcatccaggaacttctgcagaatttctctttggtccatgctgcagagcaagaaaaatagtctataagtaggttgagggagggcatgtcaaatgtgtgtcatggccgagacacctccaaaaagccactgctgccgcctgagcagagcatgctgaaggctgtggtttactgacttcatcacaagccctagaggaaattagtacgtaaccaccttctgtggtcacataacacagccatcatctcactccagggccctagtgccttccttctcagcaaaggaacctggttacaattcaaatttttaacaaacaagaggctaactagaacgtaaagtgtggtctgcttaactgagattat

SEQ ID NO: 1053 - DNA, 500 bp, Homo sapiens
cacaagaaggctctgagggcctgtgagccataatgactgatttcacccatgagccaattgcagaggcaacagaagaccagtgcaccaaccaggctgggtccctccgccagagggtgtcaccatctaagctgaaagtgtttggggagatcagacattgctgtctggtgctcctctctcagtggccatcatgtctttgacatctgcttaccagcataaattagcagagaagctcactatcctgaatgatcgcggtcagggggttctcatccgtatgtataacatcaagaaggtaagcatgaacaatgggactagtactgattattccaacaataatagggcagggaaccctgaggcggcaggtgcagcagttagactcccacctttttttccactgcttttccactgactataatctacataatcactcagattatacaggccagccagttcaggaaggcagaagtggaggcttcttttcaaggcttcccctttctagatat

SEQ ID NO: 1054 - DNA, 500 bp, Homo sapiens
tcctgggtgggagggaaacttcatttcactggaatgagttgggagagaaaggccctcagcttttagagacacaaaaatccatgaagtctcttcctttctgggctttgttagtcagagcaggggatcagaggagactgaagcagaaaccctgcacacgggcccaggatgtggctgattttgtggttccggggagtatgtgatgataatcacccccagcagattccattacctcagcagctcttgttcccccgccactggcagttctgcaatgccatagcattttccagagctaagatctctgggttgtatttgctgacagcctgcaagcttgcatgctctgaaagattttttttagtttttaatttttttgtagagatggggtctcgctttgttggcgcaatcctcccacctcagactcccaaagtgctggaattacagttgggagccactgtgcctggcctggaagactttcaacttgtgtctcagtgcagttcttgact

SEQ ID NO: 1055 - DNA, 500 bp, Homo sapiens
taattacaggtgtcacagggctcactgtttgcctcataaatagggctagattcaacgtgtctggcatgtatctggaaaactggtgaggtggacctgacaaaagtctcttggataaaatgtattctaaaagtgaagaaaatgagagacagatgacttgacttagtcattgtaggaggaagtaagtctgagtacagcactgtgttctcactaagtttatctaccggttgtgcccagcaaaaacggaagtaacgccgaactacaggtggtccctgatggcctcagacagactcagcaataggcatgtacagggtgagcaggaaggaatacctggcagaaacctagtaccccatggaggggcctgccacaaaagaagagaacaaatgagcatgacatttgagagctgtagatgatcagacttgttcagtattgcatgggaggcatcctatagagatgccccataacaggacctgtaccactgggcagcaaaaagagatagggaa

SEQ ID NO: 1056 - DNA, 500 bp, Homo sapiens
gtgttttagagacaggggtcttactatgttgctcaggctggtcttgaactcctgggctcaaatgatcctctcaccttggcctcccaaatgctgggattataggcatgagccactgcatccagccaaaagagtttattatggtttaaaagcacctcatgttccttaaaactttgtcttcttgagccacagacccgtcctgggaacattcaataaatggccttagtactaaatgtggtaaaccacgagttgcgacatagtcaaataaaacttcctgaatttacctgctgtactttgtcgcttgtttcctcttttcccccagctcatagacattcttgtacaccctatcaccttcagagagtggctttttgaaagcgaccttgtggtgattgctggctgctatggatggctagctcaccttccagacagtcattggatccccaacatggtggcaagattacttaaggcaggcactgctaggttttcttctgtttcataggaaa

SEQ ID NO: 1057 - DNA, 500 bp, Homo sapiens
ctctctgtagaagtacccccaccccacctggtcccggttaaagagagagggagagagatagacaccagacagacagatactggttggcaactcagatctttgcaggcttgcagggcttgtgagggaagcagcagggtgagcaggaagctgtggggactctgtggggcctgcctttggcctaagttcacaaaataagcagcagatgcagcaaggcctctgcagatttaaaaaaaaaaaaaaagcatgttgcgtcagagcacatgtctccccaaagggtacgtgtacgaacagcatgcagacttgtgaactgaagcccttcactttcccaagtgtgaagagctgggccttaacttgtttccataaattgccgtttagtttaagctgctgtgcagcacatcatctctcctagtcaattgctaactggtagtgtgcaccatggtaacctgcaggccaacagatcctgttggatcccaggccaacagatcctgtggagcaaagca

SEQ ID NO: 1058 - DNA, 500 bp, Homo sapiens
tgacaacttagaaaaatagtatgaagagacatacggtgctgtgagaatccataataaagaaccctagtcagaaaagtctcaaggaagtgacgtgatcgttgtggtctagagctgaagaattaatatgaattaggtaggcaagaaagggaagtacaagagctgctttctgggtaaaagaaacaacatgggcaaagattctggggtcagagagatcacgtcagtgcacttgccagtttgccaagaacaggccgtattcactttcagaagtgttcaggtttggatagtaaattgcagggccatcctatctataagggactctaagaagcatggttctgctggagcaaacagcagctggacaagatgaggctacatagacactaggcccaaaggctaagtgaagtatgtttttcaagacaatgaggaagctattgaaggatttgaaactgggtggtagcttgatgggactggcaaattgaaagtttttactttaggtataaatc

SEQ ID NO: 1059 - DNA, 500 bp, Homo sapiens
gacttcctgcaaagaggacccttacagtatttttggagaagttagtaaaaccgaatctgacatcatcacctagcagttcatgcagctagcaagtggtttgttcttagggtaacagaggaggaaattgttcctcgtctgataagacaacagtggagagtatgcatttatttatttacttttacatttttgattcgtttttacagagaaaaacttctacagagataacaattattttgcttttcagaaggacgcatgctgtttcttagggacacggctgacttccagatatgaccatgtatttgtggcttaaactcttggcatttggctttgcctttctggacacagaagtatttgtgacaggtaagtacaaggatattaatattttttaaattattttttctcttttggaggaatgtttgaaatagacataaaaataatttaaatgtgttggtaactggaagtgagaagcctgctgtaaaccatcaagattgttgtctcag

SEQ ID NO: 1060 - DNA, 500 bp, Homo sapiens
gatggtaaaccctcccattctacgaatagccaaagatacacacagccagcaggggtctgagctaaatttgcagtatgtctcagagagatcaggcagaggaagttgagctgtctgtttaccaaagaagaagcagataaaagaaaatagggaacttgaagtaggtacatgcaaagtgagtttgacatgggcagagaggccattctggtagctaaaaatactgtgtagacaggcagactgaggggcaccctacgcctgttttgaagattaagaattgttacatgctttggaaattctcagctagaagtacatgatctaatctgcattctaagtaactgtcatacaccaaaacaaacattccaccctgtatatgaatatcttacataccaagacagaaagatggagcaatattaagaaaacaagcctatgaaatacagaagttaagtttgggccggacgtggtggctcatgcatgcaatccctgcacttcgggaggctgaggca

SEQ ID NO: 1061 - DNA, 500 bp, Homo sapiens
ctgatgatgtggttgatctctgcagaaaaccccacagaagccccaaactgctcccgctacttccagtttcggtgtgagaatggccactgcatccccaacagatggaaatgtgacagggagaacgactgtggggactggtctgatgagaaggattgtggaggtaagaggcccctggggcctgggttagccccataaccaagacacaccagaatagttccaccagctatgcaggatgtgcctggctgattccgtgttttggggggcatatttttgtgagaggagtgactcaaattttttctgttcctctttctcattttgaaataagtgtggttggtttctcctattttcaggctatttattccgtatttgcagggcagagtgagaagtctagagccttcctactcaaagtatggtttgcaaccagtagcatctgcatctccttggaacttgttagaaatgtagaatctctgacctcaccccagacctacagagtcagaatc

SEQ ID NO: 1062 - DNA, 500 bp, Homo sapiens
agccacgattggaaatcctaaatcataaatgataatatttcagtattggatccccatattagcatggggaaatatattaatataccaattatagttgtcaaacaaaaagtaacctactgagaaaaatgtgagtggcaatggttcagtgttcctcagctttgttgctgcccagctcagaaatcttttctgttcccatgcaccattcacatacatgcaagtcatttcatggaaaagctgttttcttacctgcgtctaggccttcatctgtgagagtcatgcttcactcattttgaaatacctctcattgtaggctccaaggtaacactgttacagagttcttgctcatcttcaactacggatgaaaatcaggaacttgacagaaaccacaagatagtgggtccctctgctgctgttgtcagatagaatttattgaagactgggacgtggaaacaaagaggaaggaagagacgttttaatctctgtgggtgttaggctgactt

SEQ ID NO: 1063 - DNA, 500 bp, Homo sapiens
gtccatggagagtattgcattttcttagtttaggcatggcctccacaataaagattatcaaaagcctaaaaatatgtaaaagaaacctagaagttatttgttgtgctccttggggaagctaggcaaatcctttcaactgaaaaccatggtgacttccaagatctctgcccctccccatcgccatggtccacttcctcttctcactgttcctcttagaaaagatctgtggactccaccaccacgaaatggcggcaccttatttatggtcactttagagggtaggttttcttaatgggtctgcctgtcatgtttaacgtccttggctgggtccaaggcagatgcagtccaaactctcactaaaattgccgagccctttgtcttccagtgtctaaaatattaatgtcaatggaatcaggccagagtttgaattctagtctcttagcctttgtttcccctgtccataaaatgaatgggggtaattctttcctcctacagtttat

SEQ ID NO: 1064 - DNA, 500 bp, Homo sapiens
gggtaatagagcaagactcagtctcaaaaaaaaaaaaaaaaaaaaaaaaaaagatgccttgacctggtaggtgtgccccaaactttctttccagtgtgtgtgttaccaaggtgagggctgaagctgctcaaatgctccatgaaggggaggaagctgtgggatgatggggagggttcccacaaagatggagcctcgtcagcctttctccagcaccggaaaccacaggaaaccaggtcagtgtgtggggcccgctccctctgctccagggctcagctgtgagctctggggcttcctgagcagggcgtactgactagtgggtccttgaagctagaggcccctttggtatggagccctttgcctagaagagctggacctggctcatgggtagagagaactcggctatagtcctgagagttaaccagttgggaagccagggtacatatgggcttcatgtgcatcctagagtgctttttttcttccccactctaaatggtgcctca

SEQ ID NO: 1065 - DNA, 500 bp, Homo sapiens
gcgtaaagccttcaatgcacaaaccaaatgcttggcttggagaccataaaatgcaatcagcaatgaaatctaggttatatcactcaactttcaaaagtctaatgcccctttttatccttagaaagatgacacaaagaaatgacctgtgagggagacttctggttagcaggggctccccaaagacactgagcccacagcaggaagtggaggggaaacctcagtgactggtccgagaccaacctggacttccgtgtaaggtacaatgcagataaaggggattactgtacttcaagtgggttctgaagcattctacattattcaaaaggacaaaaatctagtcaggtgttgcccaaatggtctcctctgtgatcatttttctcatgttgttcagaaacgtagtggtgatagtgcatttgtgagactctgtggccaggaaacaacatctctgtaaccccaattttaaaatcatgacttcactgtcaccaaccagcgaatgccaa

SEQ ID NO: 1066 - DNA, 500 bp, Homo sapiens
gttattaaatgaatgggaatgggtggataggtgtgttttgaaagcaatgacaatgtgagctttgagaaaaggtaagattcaaacctctggatgtaggaaaaagaaatcatcttgggcaggagaaatatctcttcctaattacttgaggagtagcagaaaagacatcttaattggcccaatgtcatggggatgctttcgctgccattcctggctttaccaccaggctgctggttgggctatgtgatcagacgggtccttcctcgctgaaatgtgctgggccgtttgtgggcagcctcaggtccagcagagcaagaagggaagttccctgggaccagcagagtcatctacactgtggtcttggacctctagagggcaacagataggaagagaactgtggcctaagtcctcactctacatagggagaagtctgcctaaaagaaatggcccctgccctggaggcgttcagtggtgtgcagagggacctagcatagacattgctg

SEQ ID NO: 1067 - DNA, 500 bp, Homo sapiens
gtcaactgaaaggtgaatctaaaagtattttaatccccaactttagtgaggtactttgactgcagtgttccattaatacaatcaaacagctacatgatctcatcctgttgccatccaccagctgcccagtagatagtaaaatggctagaagacggtcaagagaagaaagactaggctagtgccttagagaatgcacacacaatcacctaattaactgaactcttaccacagaagcactgtttttaaggacgtttcaccacctcacagggaggccaatatcgacaacactcagtacagtcttctttttagttcaaaaccgttatactttttaccacaaaggaagtgtgcacattgacagaagcagataacctaccagccaatccaatactactgctcatctcagcggggatatcacatttcttgatatatgccagtcctttcagttacatttcagttttaacaaataacacaagatagtaaaaaaaaaaaaaacaacaact

SEQ ID NO: 1068 - DNA, 500 bp, Homo sapiens
ctgtgcccggccaggaagtttttaaggcagggagatgctggaatttgctcttaggctgaggaaaattgcaaaatatgtagaggggtaggtagtcacagaaattgttttctctaagaaggatatttgttgaaagtaaaggaaatgacgttggggcttgaggtttggaataacaactgcagatgagatggggcctcagcaaaacggaactgccaagcactggtatcagggacttgggatggcctgaaccatcgcagccctgagtcatatgacacagcagttttcttcagccctgcccgtgaggtaggagactgtcaggttggttcaggtaggtctgaaggttggtaggttaaggctggaggtcaagggggtcaggggatcaggaagctaacaggtggtaagtagttcaagggattgagcctaagttcaaatataggtgcaagaggggctgaagggctggaagaaaacaaactgcctgaggagctggaactggaggtccatgt

SEQ ID NO: 1069 - DNA, 500 bp, Homo sapiens
tttttcttttttcttttttcttttcttttttttttttttaagaggaggcctctccagatattccccaagctgttcttgaactcctgggcccaaaagatcctcccgactcagcctcccaaggtgctggcaatataggcctgagccactgcgcccggcctctctcatttattttcaatcactcctaaccctgccttccttcccacttctgcaccctcaaaaagaaatgtacagaataatgcaagcaattgccgctgttttagcagttttgctcatagccactgcctctctttggaattatattctatcccattcaccaacatcactgaactgtccaccaaggtattgtgttcggtccctatttcactcagaaatatattgtacattttccctccataattccatccacctgtctgaacaagtgaaaaaaaaattgtgccacaatttctactgtcttgacaaagattacttctgatttgcttccccaccccagataagctaaa

SEQ ID NO: 1070 - DNA, 500 bp, Homo sapiens
attatctcttcttcttcacttttcaaggaactcaatcctgcactaaacacattacaaagtaaagctcaaggctcaaggtgtgatattttccataatttgaaacagttacacatggatagaaatacatttgctacatagactacaagcttcgacacttaggaaacctactgaaaattaacaggatatgagaagtgaaaacgtggtacagtgtagccgcaaagtatatccatagtatactttgtagccacacgtcaggaggaagttacctttatgcaccccttaccactgcatgcaaatttgatattttctctacatgcttttggaaaatgtgctaataactaaatcatcaacacagtacttgcaaattgtttttaggccttcaactcttaacagggagaacatgagaagtttctcttccacgtgcaaagtgaaatgttacaccttataaagtctagactttgagaaggccataccatatcagacccatattcaatccacta

SEQ ID NO: 1071 - DNA, 500 bp, Homo sapiens
cagattggataagacctgtctggcctttggctttgggcttggctccagtgaggtgacactctcagaaaggtgagtatgcaaggaaggcaggaaccctgatgtcacttacctttagatccaggtactccaggtctttcttcagctggaggtaggtatcatcagccttcaaatgaagcagagaggaaaaaacacagttatgaacaccaagagtttccataactcgaggtttcacatgtgaattatttacatcgtgcagctttgggaacaaggaaccacagcagaccaacacatcaggggccacagaggaagcacaaatgtctcggtgcagctgagagccgtctttcagcagggcggatcttgcaggtcactgtggggaaagtcagcttgtcccccactggctaggggaagagtttggcagggaggatcctaccccagggctagggtagctgaggcagtgctgtgctcccaagatagacctgggaggtccacctggaggagca

SEQ ID NO: 1072 - DNA, 500 bp, Homo sapiens
aatccattagccttacctaagaccatgcttcatgcctccaaagctgtgccacccaatggaactttctgcaatgatggctatgttctagtctgtgcagcccaatgtggtagccactagccacatgtggcattgagcactttaaatatgacaagtgtgactgaagagctgaatttttaattttaattacatttaaatagtcacacatgtggctagtggctcctctgtgagacagcaccgctctagagcattcgatcttgttgccatccatccctttctggtaaccctgtgctcttagctttggtgacacagcattcttctggttctctgttagctcctctctgtttcctcttactcctcttgcccactaaaaatagcatccccccaaagtgtctgtgctctgcccttctccctctgctttctgcactgtatttcatgtctggcgaggcagcccctggtttctaatttggagccgtgtggaaatgacacccagcacggtctct

SEQ ID NO: 1073 - DNA, 500 bp, Homo sapiens
catgttttctcactatccaaccacatcagcaataattactccttgacgtcatccaaaccagcagcccctctttttccacccagcctaccactctttctcctgctttcagtttcttctctatccaacgtatggcttcaacactgaatgctttaatttaccatcttgtcattgtcctcaccctcctcactccagtcagctctcttcacacccctgctgactcataccccaccatcacccacccataagtgccggctactgagtgcaaccacatcataccacagactggctttatgacagatttgaggtcatgatcaagaaaaccagagccaggcagaagttaaagtgatgaaaacaaattttattcaggactgttgcaatagggaaagcgggacctcagtgtagaactgggctccattctgaatgcatcagtgataagtgcggatgtatagtcagggagcagggcattggtggatagaaaattgctatgaggagacatcaag

SEQ ID NO: 1074 - DNA, 500 bp, Homo sapiens
aattccgtttggcccttttcatgaaagtcagtccttaaaaacttcaaaatctccaggtaagcactgtttcctgggagagacagtgctcaaggagaattgctatctttaaaattgtgcctcaggaagtgaagacaccctgtggagaagcagttggtgctgtcacaccgtctggtccacttgccaaacaccctcctccatcactagttctgtttttttacgagggtgtgagccagaagacagcagccttgccggaaggcagagtttgtggtcagaccgtgtctacagcacctcatttcatccttcccaccacctggtgagatagaaacctttataaaggaagaaaatgaaggtcagagtggtaaagtgatttttcagcttaaatgtggcagaaccaggatttgaacttagaactacctgactccaaagcccttggttgttagattgtccctccaattctttcttaggagtcacagtgggtttttatctttcagagtcagaac

SEQ ID NO: 1075 - DNA, 500 bp, Homo sapiens
tctagtcagcttggagaaaaggccacaaacaaagggtgaggggtctggagtcatagtaacctctggattttcccgagagtctagctaaggacccagcatccagcaagataggagaccagtttgttttgcagaaaatggaaggagagggacaaaggcttttccagctttctttttcctagaagtcctagaaactaatatcaccctggaaaaaatctctgtcatccctcaaaatgggatatctgatgtaatcgaaactgccagcttggctgatgacaaattccaaggggatgaaaatgaaatgagagaaagacaaatggggaactagaaaaaaaaataactgtcagagaaaataagcagcggaagctgatgaccaaaaaggggaaccaaagtcttaatgtttggcctggagtagtgaagacagaagaattacattacaaaacacattcgagaaatggaaatgaggaggatgcggtttaggccaagatgtgagggcagaccct

SEQ ID NO: 1076 - DNA, 500 bp, Homo sapiens
tttgaagtttcccagcctacttatcctccccttctcaagagaggatagctgttccctattactcctctcatccactcatcccttaaaaaaaacccacaaaaccatcattagtaaaaaaacaaaaccccttcaagtattgggggttaggggttctgggctgggacttggggttatgggtcaccaatgaaagagggaggggaagaggaggaggagccatcactgtttctgctgcagggcttccttccttgccgcatcctgtagcaactgtgtgtcgacctcatctgctggcagctgcacgtatcggaccactgagccccgaatgaagcagttcttcactgataactagacaaagatggacaaatatgaaaacacccttaaaaatgtcctctaaccacccaggggcctcctgctttagaggtgtttcctcttctccacagaccccaactcaccatgtgagggtatttctcagggtctgtgacactgatgtcagttagtttgat

SEQ ID NO: 1077 - DNA, 500 bp, Homo sapiens
ctcatctagccaacagggaaaagtgctctgcccccacagagctgggccataggagaggataagctgctgggtgcagagggcggtgagcctgcactgtggtttgcccatttcacaaccattcccagagtcaaatcatttctcccagatgtgcagaaacagaaaccattgtaggaaactgggtctctaagaagagccgctgactcagcccttatttggttctgtggctgggggtgggtgagcctgggcttccgcttggctccctagagggtagtgtggctggcagggcatctgtctagacactctctgaggctctgcccagcctgttctttggaatagactctcctctgcttctcagggctgacagctctgagcccaggaaagcaagagggctgaattgtgtcccccgactccagttcatgatgaagcctaacccccaccgccccatacagaaagtggctgtatttggagatagggcctttaaatatcaaagttaaaatgag

SEQ ID NO: 1078 - DNA, 500 bp, Homo sapiens
tcctccccttctcaagagaggatagctgttccctattactcctctcatccactcatcccttaaaaaaaacccacaaaaccatcattagtaaaaaaacaaaaccccttcaagtattgggggttaggggttctgggctgggacttggggttatgggtcaccaatgaaagagggaggggaagaggaggaggagccatcactgtttctgctgcagggcttccttccttgccgcatcctgtagcaactgtgtgtcgacctcatctgctggcagctgcacgtatcggaccactgagccccgaatgaagcagttcttcactgataactagacaaagatggacaaatatgaaaacacccttaaaaatgtcctctaaccacccaggggcctcctgctttagaggtgtttcctcttctccacagaccccaactcaccatgtgagggtatttctcagggtctgtgacactgatgtcagttagtttgatgttgagatactaggaaaggaaga

SEQ ID NO: 1079 - DNA, 500 bp, Homo sapiens
tggggtttgttgacagcatgttcaaggaagacattctgatagctctactcttgccttttccagtaatgacaacaacaaaataacaacacaataaatgggcaaataaagctatgggattccagctgactgcctctgaagttgatctcagcctgcatggtgtccagtcaaaaccggatgtggggatgacaaaactgcctcccttccttccctccacggttctctcccgtaatcagcttttctaccacacagcgagcaaggccaacttccctaaactaagaatgctgagattcttttcgacttataatgttctgactgtctctctctgtttccccttacctcagaatttgtttaatagaggaaatatgttatgtctacagatattttctgaaactgaaagaatgaaaccacccacctgccatttcctccctgagacccataactggacaggagggaggtgtctttgactaagaatttagttcctggctcccaaaggcattgac

SEQ ID NO: 1080 - DNA, 500 bp, Homo sapiens
atttgcattcacaagatatagaaattactcatttctcggtaagtcctggcccagtatgtatatcccatttcctcccttaaactgtatcttgcaccggactattcacagacacaattttttaaaatttagtttaatatctgtcaagttcacttttattacaaatattacccttagatgcattttcaagcctttaaggaagagatgtggcagtggaacagatacaagaactactgagtgtgtcataaggggcggttgccaccacttcctgtgcatgtcctctgagtgacagtgaagaggatgtgtgtgggtaatggctccccgtatacctggggggctatgtcacatgcaagacagaacactgacaggaacaccccaattggagtgggtactaatgtgagccagggcgcttttatctttcttgaatgttaataaggaaagcaagctcagaggatggttttgaacactgaggaagaagcactggcttagcttcctacattgtg

SEQ ID NO: 1081 - DNA, 500 bp, Homo sapiens
agtgtgcttcagcatactgtcatatatatccactaactgatcacccccatttttgttgaaaatctgtcacagccaccagctggacacacatgcactatgaaatatgatccacccttagggagtaatagaggaagaaaaaccaagaaggagagagaaaccgtcatcatcaaccaaggtgatgtaagcttctataattagaatcagtgaaattgaaagaacaataaaaggcaccactatgcttctgctttccgtctacactgcgtatcaagcatcttcatacctgcacaaaaggatacattttgtatatagttactcaagtatatgcaaacctaaagtttcaaacagcgtattaattttcttcaaaaagagagtaacatatataaatgataaaaaatgaactctcatttaaaactatctgtgaattcctgggttcctttatatcccttgttcataaagatgaccattacgtcccttctctacttttaaatactacattttct

SEQ ID NO: 1082 - DNA, 500 bp, Homo sapiens
gtgtatagatcctaaaaatctatacacatgtattaataaagcctgattctgccgcttctaggtatagaggccacctgcaagataaatatttgattcacaataactaatcattctatggcaattgataacaacaaatatatatatatatatatatatacgtatatgtgtatatatatatatatattcaggaaataatatattctagaatatgtcacattctgtctcaggcatccattttctttatgatgccgtttgaggtggagttttagtcaggtggtcagcttctccttttttttgccatctgccctgtaagcatcctgctggggacccagataggagtcatcactctaggctgagaacatctgggcacacaccctaagcctcagcatgactcatcatgactcagcattgctgtgcttgagccagaaggtttgcttagaaggttacacagaaccagaaggcgggggtggggcactgaccccgacaggggcctggccaga

SEQ ID NO: 1083 - DNA, 500 bp, Homo sapiens
ctgatgactcagtctctctgaagtagagggtgataggaagagactgaacggctggtggggagtgggggttggtgcttgagaagggtggcagtagagagaggcttgagttgtactgtgatttgagagtgctgccactttgcggtttcctggctttgcgcaactgctgtgtgcaaggctgagttgaaggatagttcgctcacccaaaattgtggttttaggaggaatgtttgaaaagataatgagatgaaacgaagatgttggttggagtggccaaagttattaatgttaacagcattattttcagccttggaacttcttttcttagtgtaacattagaagtgttgagagaaatcccaattagttagaaacaaatttatcactctatccccagaaagaaaataaacatctagctaatctcacagaaatgtcattttgccttattgcatatgagaaaaacatctgacttttggagcccagtgtacactctgtatttactgact

SEQ ID NO: 1084 - DNA, 500 bp, Homo sapiens
aacacacgtgaacactcccctctgtgcaccactttccatccatttgtcctccatgataataatgaagttcattgggcctttactgtgtgtaaggcatcattttaagcactttataagcatgaattaatttaaatccagcaccccaatgaagtgggtactgttattattcccatgttatctgggggaaacccagtgacctgacccaggactcaaaccctcatcctccagagactgcacgtttaaaagagacggcactgctttccccaaatatgggtgccccatactcctcacccacagccacaggtgcagatgtggttaacaggaacccaaagaggaaatgcctccctggcacatgctatgatcatagagtcataaaacattagagatggaaaaagccttacagatggttctcaaccctggctgcacattagaatcacctgaggagctttcaaaacataccaatacccgagcccaccccactcaacactctctaggggcga

SEQ ID NO: 1085 - DNA, 500 bp, Homo sapiens
ctgccgtcccctcctctgagacactgaaggggaaagagcctggtgcctggagcagggcagagaaggggaagctgctggctgccctcctcacttccttcctgccccttagacaggcagggacaaggtcgtcacagctggggcggggcagctggggagggggagtggggacagggcagcagcctgcctcagagcaccccactgccctctgccattcccaggagggggttccagagaggacagaccctaacacggtcatcatgcccttctctgcaccagggccagggttccaccgtttcacacagcttgcttactagaagaacactaccaactttggaagccaggactgttaccaagcccatttccagatgaggaaacagctgtccagagaggtcaaggcacttgccccaaatcacacagtagttagcactggtggcagaattcaaacccagatctgtctggctgcaaaaatagctattgtctaggaggcatttcctgcctct

SEQ ID NO: 1086 - DNA, 500 bp, Homo sapiens
aaggccatctgtgttttccctgtttactgtcagagacattgtgaggacacaaacaggaagacttgtgttttagcaaggttattaaaaatggataaaccagttttctgagaccctgggatccatgcagacagctaggttagtggcctttctttaacagtaagagcagaaaatttttaaagaatgacagagaaaccagtctgtggcttaaataaaaagaccacaagttccttctggtgtcttgggaggcagcggtgtgaaaacaccacgcaagggtctggaggaggcaggagatggggagagatgaaaaaggagaggcccacagtatggatgcctccggctgctctgctgatgctctgtgtgcgaggaaagcctgtgctggcctgtccaccccagtctgattctgtccccatttccagcacgcccctagttactcctgctgcagcaggcaccctgccacccagggcagtggcccacgggccaaatccaggccctgtttttgt

SEQ ID NO: 1087 - DNA, 500 bp, Homo sapiens
ctggtgcctgtgccatctcccctctctgccaggacacccagaggcccttgtgaatagcaaagcccacttaacggctgagggcaggtgggggtatttccttctcaattctgctcaaggcccgttgctgttctttgaggatgttgcaaatccagggtttggagggctgggcctcttggtggcctggttgtctatctgatagggcggagccttcacccttgcagcgagctctctcacaccagatgtgctctgcgtggaatcctaggccatcaggggattccttagcaagccctgcaggacccaaatcctaactcagaccctcatcctcctactcagaatgtggagacttgtgatcctcagtttggacgaattccaagagaccttccaattcccagaggccatctttggttctgttcacacatagctccctctccctcctaggccttctccctttgaatttctcccctacaccatcagcctgtatttacttctccttcttgctt

SEQ ID NO: 1088 - DNA, 500 bp, Homo sapiens
taagaagacagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacc

SEQ ID NO: 1089 - DNA, 500 bp, Homo sapiens
aaaggctgggttatacaaagaaaacaagttgctttattatggaacctctcaaagatgttaatgggcctggtggcccttcaggaagcctattgcgagcatttcctacacttaaccacagaacttttttggtctcaaaatatgtctcaagactgctgaccttcagggctccagtttggagaactctattaagaacataggcagcagctgtcagtatttccccagtaactcttcaccacatgccatcgtggccgattaaatataagaggaccctgaatccgtaaataattcctttcaatgtttttccaattctattgttagaattttttaaagcagctttgttggaaacaaagaatatagttgcagaaacttctaaacaggccagttctcagaaacttcattctcctatggaggaacgtcagctggtttgcagtgacagttgtcacagactacacccaggggaaaacgtgtcacaccagtattctcacaccatgttcactctg

SEQ ID NO: 1090 - DNA, 500 bp, Homo sapiens
cacgtacacgttatctccttctaaaacatcagctttagctctaagtttatcaaaaactcatgcccttcattcttttaaactggatatccaggggcttctggaagatctcaaaaaacagacagtgcattcgggggctttatcccagagcagtcttcagaggaggataaagttcctcaagaagtgtctgcccctgtgcatttccacccaccaggaccccctttcctgcacctctccccttcctgagccccccggctgtcctccaccacagccagagggaactgggcctcattagggggacagtttgttcctcattaggggcaccaagcttggctggagaaaagccagctatcactttatccaaagccaggaaatctcccagtatggaagccccctctctcccattctgcaccaagtccttcattctcgctacttcacggaaaaccttcctctagaaggaagtaaaaaaattcccccaaaatatatcagcccttctgctttag

SEQ ID NO: 1091 - DNA, 500 bp, Homo sapiens
tttttgtttgccaaggactcaggaaaataaaaagcattttctatttttaggacaaatcacaaatgaagtgtctaactggctattactgtttacccatataaaatatgctgctaaagtacatattttgctgtcaatggcttgacaattttttttttcaaatttggacatgagaggttatatagggactatattatccaacacatattttcttattttgccacaaatttccacttaacaaataaaaaaaggcgaatgctgttttgcaatcagaaagtgaatttcttttgtggtagcgtacacgtggttcatgtggttctccacgtttaagcacaaaccacagcacaggaagccacaccccctccagcatctctgtcttgtggggtctttgaggagaaggaatcagaacatcgacacctgggaagagggaggcggggaacaccagctggactctggccaaggagtgatgtaagcaggtgacacttggctgtcagctgagcttc

SEQ ID NO: 1092 - DNA, 500 bp, Homo sapiens
tcaggtacagaagttggcacagggaggcgccagcaaagagtggctggcccactggaacagagacccagaaaccaaactagacagtgaaatcagtagtgaaggcccccccctccaagctgtacgcaagttggaagggacaaaccactaagttacaaataaggaaacaggcttggaaagtctgagggatttattcaaggtcaccaaaccagaacccaggtctctcaacgcttaacagctgaatgacacacacggcactgcacagagagacacataagacagctcatgtgggcctaaccagataccagtttcacaaacacacacacacagagagagagagagagagagaggcaaccgtttaactacatgcgagcactccctgtctgccaacaacacacactcacaccaaccctgtaaagattctagaaagatgatcatcccctctggagaagggactgactccccaagtacatctcaactgttggatttttgccttcttgcaa

SEQ ID NO: 1093 - DNA, 500 bp, Homo sapiens
aaactctgaagtaaagagtaaagcatatctcatttattacctatgtggagttcagtaatatgacttacctgtgttatgtctctcgggagtctgcagtgtcttgtatccctgggtatgtgactgtgccttgggtttatatgacgagtaagtgataatcacgagccagtgagaggacaggcaacttccttctacctaacgctcttccttcttttcttagataaaacatgcatgccaggcagttcaagcctgcgaagactgctggttatacaggatatctgggtataaataaaccaacacatttgtatacaaggtaaagtcaaagttatagctgcatatgtatgcccactgttacatgttcacttattttcagttttacaccataggctcctggagaataagaaaacctgaatgtaatgaaatcatctttgcagatgtgcacatgacttgcttctctattttagaaacagtctctcctgtacctgctgtatgttccttcgagg

SEQ ID NO: 1094 - DNA, 500 bp, Homo sapiens
ctgcagtccctggattatggtgctgggggctcttaataggtgagactcattgtgaaatctgcgccctaaagtgcagctagaactaaagccctcctccacctaacctgaactttacactgtctagctgatacttcagctttacttccaatttcttccccactacaccccctcttttcatggggataggtgaagtgataaaaatggaagagaagaggagctcatgggggaaccgcttggcaggggcacttacgccagtgtaaacctcagaccagtctgggcaacagaatcccctcaaagtcactctgcattcttcctgtacagcctttaaaagtagtatcgctggcaccatctgccccccgttaggcagtcctgctgttgaaatttctgagctgcaggaatgttatccatttcagtatgttcacattaaaatcagtgcagaaaggaaaaatcttcactagctgcttcagcagaactcagaaagagcagcacagcagcgttcc

SEQ ID NO: 1095 - DNA, 500 bp, Homo sapiens
cagaggtctctcctacatgctccattcctcatgatttgggagggggcccacctaccacagtgggaggaaggagaatggggatgcggaagtgggagaggagagagagggtctccccaccttctccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgccct

SEQ ID NO: 1096 - DNA, 500 bp, Homo sapiens
tgtgagcacatgttcctgtctcactcttgctctgcagcacagtagaggctgtttagttcatcacaaaggaagtgcatcagcactcctgaagatgctactctaagggcacctttgagttgtgggccaggaaggcattccatagtaagacgaaggaaaggccaagttcctattgttagcgtcactatgcttctggttttatagtttcctaagttattgccacaggtcatggatctgtggcgctcaaatgttcgctcacaaggttcacagcacattctttgcagttgcaccacccagctaggaggggcgaaaccaatggagcattttaggcagagctcatttccgcccacatcaaaagtaagagagaagtttgtggagagctacatttgagccctccattagctgttttacatcttgtaggccaaggtgacactttctacactatgtgctggtgagataccacatggacaaaatgttgtagaggacccagcctgaaaaatgct

SEQ ID NO: 1097 - DNA, 500 bp, Homo sapiens
ttgtacttttggggagcaagtcaaggaatgatggtcttatcgccacataatgctattaacaagcatggtttccactcattcatgcctgctcaattttttaagagggcctactatgagttaggcactaggcttggcacagataaggattctgagctgataaagcctgcagttccacagtgaacactgctgtcagacagtcactgcacagataactatgcaaccacaatgacagctttgaagcggccgtggcgatagggcaaccccatccagcctgggcctttaggggagtgtcaaggaagagctctctaaaaagtaacaaatgccgctttcttagaacttacgaaacttaaaaaaaaataaggcacacaaacatattgtctcaaatattatataaactccaaagtaaggtggggtatgggaaggggaaagctctgagcccagacagatctgagtagaatccttactataactacagcaccttgagcctctcatagctccct

SEQ ID NO: 1098 - DNA, 500 bp, Homo sapiens
gcccctaaaaaataaaatgatcatgaatgcttagcaaagaaatcaactaaatttcatttatagtcatcaccacccaccccttctctccacaactagaataaaagggcttcattaaaggaagtaagaacaaaaaactttcttgtctctcaccttctacataaaaggtttactcaggggaaatcaccatttgaaagccagttttatctgggtcttacttagaaacagccttaccagaatgcagaagtggagcgagagaagaggagaaagaccgtctttaagccacatgtctgttgctgctcacaagggagaccgttgggagagccaggagctgaacaggcagagagacccacgagcgttgccaaccatctcgttctgcctgggactaagggattcctgggatctggaactttcagtgctgaaaattggatagtcctaggcacaccagatggctggtgtccctccagtcctttgccccacagggtggcaggttccaaggagag

SEQ ID NO: 1099 - DNA, 500 bp, Homo sapiens
ggcaggagagggtggggggaaagggagccaggtgaggcacctgagaagttgtggcagcctcttagggacaaagctgaatttccctgagactagaaacctcttcttccgaaaactctgatactttttgtactgggcctatctcttgtcacttaggcaaattccttttcagttaatgggaccaaagagagatgtttttgcctccccctaagctggaggtagttggcttaaagtggaagaatcccgaggaggcggggacctggtaaggcccccatcattcagctgccctctcacacctgaagagccacttctctgctccaactgtggctggctttgtgttttgttttaaccaggaaggctgttccccgtgacctcaggggccacatcctgcttctgctgcctgccttgcctttgcaccctttgagtcagtgctgctcagccagcagcccctttctgagtcacagccacacagctgggccaaccgtgcgttggtttccttcccc

SEQ ID NO: 1100 - DNA, 500 bp, Homo sapiens
gccagctgtggggggttgggcctgtgcagtgcctctcagccgcccacgctggtggggctctgcagtgttagcttcttgtttctctattttctacctaggtttcagtttttcacttgggtttgtttcccctttgtctctggttcagcttccttttcctgtttggttttaagtaggctataaaaatcaagttgctgtcttcagagggtctgtggtcctctgatcaacataggctggtgggagtacaggactcgcctcctcagggttccctgtgctgccacttttcagccatggccacaaggtgagtattggaaccagtgcaggggacagagggatgtcaagaggaaacctagaatcttaacggtgaatgggctgtagaaattatctcaggtccccttagtatactgatcgagaagtccatgaccagagggcagggggcttacatgaggttacacagcaggttagtgacagtctgctccctctctagccgctggtctttccat

SEQ ID NO: 1101 - DNA, 500 bp, Homo sapiens
gaggaaagcagaactaagaagagacagagaaagcgaaagtgggagagagagagagatatgaggtgacaagtgtgggtccttggatcctgcttggtgtaaagctagcctgctcctggactttacagataataaattccttcctcatcagattaacctgggtttttgtggcttgtaaccaaaagggtctgcacggcccacacacaggctcccagctcatttcctttgcaatgagtggtaactggaggcgggcggtgcatggacctgccttgcaaggcttctctgttagtggtgcctggagcccactctctcagctggcacagccagtgtgacacatcagtccgggtgtgtcctggacctaccccctttctgggtgcaaaccagaactgaggatgccgagggtggtgggggggtagtttcctgcctcagggctgtgctcctgctacctctttgcctaaaattctcccctctctgtgctcccagggccagctcctttgtatgct

SEQ ID NO: 1102 - DNA, 500 bp, Homo sapiens
ttttctgttcatctgtggccaaagactcagaaaaatctgtatggaagataaacaactcttgcacaaaatcagaggggtgtgtgactgagatatagtgggttctggtggaaactgcactgttgactgttctcccacgacatgaaagtaaaagcagacactttgtctgaattgtcagaaaatgggtctcgttttgtcacctcctaagatgcccagcaaggagatctgaactccaagtgtcatggaccttcccgcagaggggctggccttatgtgcgcagcaacaaggaactgctcagtggaaccccagtctcacttccccacagaagttacaaaaatacttatttttttttctcatttcatccatttttaggtaaagaattttaactgtttggggttcgttacttcacacttaagaaatctacaaaccacaggaaatgaaacttgactaaatgcagatgacacagacagccaactccgaaaatgtgctgggctccactcagt

SEQ ID NO: 1103 - DNA, 500 bp, Homo sapiens
ttctgttttgagtgggggcaggcccaaggctattcagagctagtcgttaaactggaactagaaaaataaaaccagagtctcactgccctttggttgcttgtgctacactgtgattggcatgtcttggaaaaatcactttgtggccacatgcctcagtttcctctcctgtaaaatgaggaatgtaagcaaaagataataaggtcttatttataaatatttttaagaggcaaaggtagcttttattattctcgccattgctttaaacaggagacaacattcaatatgcaacactcgatagttgcctcatagagagagcacttcctttctgttgaatgctaaactagaggctgcgttgtgggggaagctgcaacatctgccttggccttgtgggaacagggatggcctccaggagaccaattagtcgtataagataatgaaaacatctagaagaaatatgatttccactcaaagcttcgaagaggactagtttaccaagtcta

SEQ ID NO: 1104 - DNA, 500 bp, Homo sapiens
ctcaccccaccccgggtgggctcctgcctgccagccgtccacctgtctgctagaaagccctccctgggcagggccacccagcaatgggtacagcctccctgggctctgaatgccttgtgtggggagggtgggggtgtctggagcggaagcctcagaccattcaaagcaaagcctggcttcaccatctaatcagggggcgaggaggtagtaacagagacagacatcagagcaaaaagatctgggttcaaacgcttcacaaccccagctccactggctgtcccccagtgtcagccaggcctgagtctgactatcttcagggatgaggcaaagcccttttctaccacccctccctctagcaggcaagccgtgtttcttttgtgcctcagtttccccttcagctagggggatgaaggctgacatgccagaggctattatcctatgtaggggcccatggttcccctgaccacttggttcccacacacaccctcaggtaacctacc

SEQ ID NO: 1105 - DNA, 500 bp, Homo sapiens
ccttaagttaaaattgataaaatctctatacatgtgtcttgtttgacaattgataataacattgaaaaataacaatattgttgactatacaaggcaatttcttcaaattgagtaatgatgtgatgtgtgtggttaactgtctctacccaggaagtggttttatttaaaagttttgtgctcaccccaccccccgcctttttcttcccccagtactgaaattaagcagcatccaacacaggcctactcttacgacatgtgactttactgttttccgtttttgttgaaagagtcattaacagttaggagttgatggcagtttcaataacaggtcattgccgagaaaaggtaagttttaactttatattgtacatgaaatttaaacttgaacatgttcggcagagtttcctacattttggtgtgaacatataaacatttctacaaaatatgacgcttttacctgtgattaaaacattggctggtttcctttgatgtagaaaaga

SEQ ID NO: 1106 - DNA, 500 bp, Homo sapiens
ctagcctgctgaaggtggtcacagcttcactgtggctaggtacgggtggcccagtgggaatggactttctgtatgaactaaggactttggaagtatctttatggaaactttgggaaggaggggtaatggggtacaaaaattgaatttctttgtcccaatccactttatccttaaatcttcaaattctatcttttttccttcaggacctggcattgcccagaagataactcaaacccaaccaggaatgttcgtgcaggaaaaggaggctgtgactctggactgcacatatgacaccagtgatcaaagttatggtctattctggtacaagcagcccagcagtggggaaatgatttttcttatttatcaggggtcttatgacgagcaaaatgcaacagaaggtcgctactcattgaatttccagaaggcaagaaaatccgccaaccttgtcatctccgcttcacaactgggggactcagcaatgtatttctgtgcaatgagag

SEQ ID NO: 1107 - DNA, 500 bp, Homo sapiens
taatttttttctccgataaaagtacacatttattgtagaaaatgtaaaaaatataagcaagcgcaaaggaaaataagccaacaaaaagtttagtatatttccttcaggctttttctacgcaaatacaaaaatactactgttcagtttttaaatggaacttgacaattatttattcattgtaaaataatcacaggaacagcagcagtgtaggtttccctacctagagggtggtatgcagtgattctcaggcgctggttggaaggcacagctgagggacacaaactgccaggaagtaatgtggtaactagccatgagcttgtggtactaatggtggcacgggaaacaaggtctctgcttgacttttattttcactccataacaaactcaccagatcaggagcctaagggtgggtggggagggagaagagagaaaaaagcaaagggaaagttcaaagtgacactcgctggggctgaaaaccacactcccctgcagatgaggtc

SEQ ID NO: 1108 - DNA, 500 bp, Homo sapiens
ggcaatgggggcaatggagagctgggtaacaggaaggccaaggaggaaggaaggctcacatggagcaatctcctcttccggctggggagcatggtccagaaagccccaaggcaagctgggagcaaagcaaggttcaggtttccactggaaggattcagctggggaaaaaaacccccacagtctccacctcctctgcctcttcagactcccattttggtttgggggagagggcgaggctgctcctcactgcggtcacagccacatcctgcagagcagaggagggggaagtaagaagcaaaacaaccagaagaaccacaggcgaagaccatggggagagaaccctggacacatggagctgatatgccaccaagagggtcctgagttcagtgtagcagaaggctcagaccttcaggactgcctgcccttcttgaggtgttggcttctcgtgcttcctcagtgtgctttaaccacactgggagcattccggggaaggaggtttc

SEQ ID NO: 1109 - DNA, 500 bp, Homo sapiens
agtgagttgtggcttgatgaagtaacacagcagagattcagaaaggaagtggtgaaatgttatggttgaattcatttaaaaatgtactaaatatagatttattatatagaacagttctggtgttctgagaaggaggaacccaaaattcgaacctcatgtttaggtggtggaagcgagtcatacagtgtaacttctgcagacacaagacctagctgcaggggccctgggtttcagaatttgttttagacacggctgcagtcacctcaggaagcacttggatccattttgcatgcagttttgcagagtcaagaacttcctcgtaactaatttgaaggtcctttccttaattttgtacagtgattgtgagtagctctatcctgttgaatgaatccatgctaattgatgtgtatgtgtggtgtgaatagccatcgtgcattttcatgggctagtgtaaaaaaagaaataaaaaatacttttcatgcgaagctttttgcaaataa

SEQ ID NO: 1110 - DNA, 500 bp, Homo sapiens
aatctcagcaacacttgaattgtagagccctgtccatggagtgttatatgggaatactataagtacagcaatatcaagaggcaagaagaaatggtagtgtctggttagtggtaataggaggaagctgtactgctgggagacaagaaaccgttttttttttgtttttttttctgtggaaatctgcaggaagcggcaaatgattatcagacaagcacatcagccatgagagtgttagacagaattaaaaagcgagtgcacacagatgtcaagatagcagctttgtaggtcttggggccccttgtaatagagacaaagatatggagatgtttcctccaaataagtcattcgaaaacgtacactgataatacaatggagtttggtgcagtgaaaagaaaactgactagaaatcagaagacttggacatttttctgacttgtccaattaattgacttatggcatgtcagttaggcttttttattacggtttcagtttaatcctct

SEQ ID NO: 1111 - DNA, 500 bp, Homo sapiens
gttatgtgagtggaagaatagaacaaatcacatcctttctttacaaaggaatttagagaacaaaacccatcattaatatttccctctttcatcatcaactttcctgtaattcagataagcaaaaactcagccacctagatttttatagccgcattggcaagagtgtgaaggattccagcagcaaacatacacgcaaggtcaggaagtgccaaagccaccaagagtacatgtgacttcgggggttgggggcgggtgcgcctgcccacccaccacaaatcttagccatctgggctgtggagaaaaaaagggaggggagacattttgtggcattgctctgcacttcctcagctgtccctaacggcagctccagattaaaaaaaaaaaaaaaaaaaaaaaaaaaagggctagactggcatatctgattttaaaaatatgtccacaaatgaatatataataagtttaaaatatggggggactggaaggaaatacatcaaaagatt

SEQ ID NO: 1112 - DNA, 500 bp, Homo sapiens
aaatggatgctctcagctcttgaaaggatgatttatacccgtgtttgagcaaagcagattctgccttcagagaagcagcagcaaagatagctcatttctcaagcagcaccccatctcatccatcacccacttcccctacctgccccccagcctacaccacaggacctctgctctgccaagagggcagggccccagccacgctgcagcaacaccagaagcgcaaaagaaaatgtgctgttgcatagacagcgcaaataaataatggttcttgtgataatcagcttttgcttttaatgggcttcacatgactcatcagctatcacgtatgctatagcctgagctctggctctaaatcaaacaagttcaaagggagaagaaaggaataatagcaaaagatgagcagatatctcaagaagccttaatcctactgaggaaaaacagaaatggaggcaggaagaagacagtttcccctatgagcactcaggtaccgagggtccaga

SEQ ID NO: 1113 - DNA, 500 bp, Homo sapiens
cttttgaaagctggaattaggtgcaagacaatagtagttcaaatatctctcaccaggatcagctaaaccgttcttgcaagcatcagtaaggaggctaggaagggtgccagatggttcgttcctagcagctacaacttcaagctttagtatgtgtagccaggggtgtacaattaccttacattaacaccaacatatgtcgggggcaagtgccagcgatatatacacgatagcgattcggggatgacacatcggctgcaaggactgctatattctcaacattcctcaaaagggtgtaagtgtcttaaacagagttcagctggcgtaatggaagggagaaaaaatcgaaaagagagggaatggctgaaaatgaaggaaaaagaacagttgaatattacagtatttccctggaaggagggtatttggagttttaatgaattgtcaccttcctccaccacaccagaaagtatacagttagaatgcagtgttctcggtgggagagg

SEQ ID NO: 1114 - DNA, 500 bp, Homo sapiens
aggtgtgccctcacaaggaaagtgaagaggactccgcctcttcaggacccttagcccaaagggctgcactcaacctggccttgacagacaaacatcaacagccgtaaaacaggagggcgggctgaaatgcctggaagtgaacagaccctgctgaaggtcagctctgtgcctggagtaggcctggccaccagcttggctctagggcaagctgccctgcacagctggatggcgtctggaaaggaatgtgaccgtgcagggcggggacctggaaggcaggattcaaagattccttcagaggctcttcgctggtgcagaattatgaaaggcatgtggagtccgtgaacgtggggtggcagggaggacagggtctgtgaagtactttggtatgtcgcctgggggttgggacgggcatgtctcgagtttctctggagaaaagtgagcttgggcattgcactccttgaggggcgggagcactgtgtttcattcacagcactgagaca

SEQ ID NO: 1115 - DNA, 500 bp, Homo sapiens
cagacggtctggctcgtcaggtggcatgggtgggggtcacgctttcactgcctgctttgggctctcaaaacccagctctgaaacgtttccaaggcaaaataaaaatagccaaaatgcctattcagaccagaggaggtagaggaagatgaccgattctgtaaaacaccctcctacagataaagaaaaggcgatatgggcaagtacacacacatctaggccatcgttcccgacttttaagtatgaaagaggcgtggctaggggctagatacttatttttaacacttccattgaaacacccggagtctcccaaggtctaacctctagaagtcgggtggcagaacctgaatcagaacccgagtgagccttccttcctccaccacctccctttaggaacgcatgcctaaatagtcgataaaatctacttctcaatgtcatgattaacccaaaagccagccacaaccaatcgtgttattagagtgctaaaagcctctatccacaac

SEQ ID NO: 1116 - DNA, 500 bp, Homo sapiens
gggcatccccagctcaaggctgcagacgctactcgggggtacggggtgggagggtggcattgggaccgggttcagaagcttggcggaacatttctggctccatctgaggctctgtctctgtgtgtctctgagtgtcccatcccactctgtccccagcaccgcggaggcagccgccctggagcgggagctgctggaggattatcgctttgggcggcagcagctcgtggagctgtgcggtcatgctagtgccgtggctgtgaccaaggtacctgacccctgacccccaaccctgaccccaaccagacggccaactctcctgagctgcatgactgctgtgaccagggtggttcacccctcaagaactccctttttgcttgggcctaccccagcctgatgggtaaactgaggcccagagaggctcatggctggtgcaggccagatggggacctgagacccctggtatcagagaaggccagggtggaggttattgcagggacagt

SEQ ID NO: 1117 - DNA, 500 bp, Homo sapiens
ggccctggcaaaatggcaagggcatgctagaccggtcattttttttatggctagggaagagaaataattattccccccctgcccggcgcccagacatgcttgggaagctgggagagcggttcggctcaacccccttctccagggccagttccaccaggctgcaggggccgcgctctgggcttgcagctgtaggggaagcacagttcgcttactttgtatttttcttgggagcttgtggggcatcttaaacgggaccgttcggctcagaatcgcagtgttcgcctaccaataaaccggaccaagcaacattccaaagaatccctgagaatttctgcctctcctcccctcccccttccgatggaaacctccctggtattattttaaaatccacttaaccatctgaatattgagctttgatggcgggcttgctagctttcttgactctttttaaactcgctgtctgatactggcaatcttgccatcccttctcaaacttgagc

SEQ ID NO: 1118 - DNA, 500 bp, Homo sapiens
ggggttatcacaaccccttgaggctggaaatgcctcttcccacctctcagcccagaaaacaacccttgctctacagcccacagcctagaaagagattgatttcccgtctgtgtctaagctgtatctcattaacccacggggctctttccccagccccagaagcaggtacttacaaggcaccggagattagtggtctagtggaccagacagactggtccaggcctccccgccggccccccttccggtccccgtggacgccagcctctctgagcctcggatgtttgtgctcggcaccaggctggaaggctatttacttattcatgggctgcccaagccggccaggaactgctttgtgtcagctgaataggatggtaattcaatctgcgaatgggagccgttggcacacagcacgcctgtcataatgagtcacaggggggacaagcacccagcgttcagagccactgggaacctgtccttcgacaacgagctgtgtcacaaga

SEQ ID NO: 1119 - DNA, 500 bp, Homo sapiens
gctgttctgcatcgcttggatgttttctaacctgtcctttttacctaaatatgagctgcttgaacatcaaagagctgtcaacctttaaacagagagagccttgaactccagattaaataaacatctcctcctgtgatctgttacatccaatattgctgaaggcaaaagtccagcccgcaccgctgtgatccatccgtctctctacgcccccaccatcaggagcccccgacactgggcttcccctactcccgtaattttttttgttgctgttgtttgagaccaagtcgcactctgtcgcctagggtggagtgcaatggcccagatgttggctcagtgcaacctccgcctcccgggttcaagccattcttctgcctcaccctcccgagtagctgggattacaggcgcccgctaccacgcccggctaatttttgtatttttgtaagtagagacggggttttaccatcttcaccaggctggtctcgaactcctgacctcaggtg

SEQ ID NO: 1120 - DNA, 500 bp, Homo sapiens
catctgcatcccaacagttgccacttgtcagtgctaagaaacccactggaacccagcgtcggggcctggggtagtggtcttgccagggaccctttgccttttccttggtactgaagtgaacattcacgtgaaggcagccctggtgtccccgcccgcatgcctgctgccctgcctggccagtgctccattgtaaatagtaagggcgagagctggcgggagcgggctttctagtggtgggcgggactgtgccgtgtctttccctccctggccaggccctggcttggcagggtgtgctggtcctggcgccgtctacggcctcttcctgctctggttggcccactgccgggcccagcatcttcattcgcccaagtgccagaggcagccttctgacaacctcgccgtgacatttgtcattttctgtgttcccgttgaggaattttgctttctcacaagaagtgaggggtggttctgattttcttttcttttcttttttttttttt

SEQ ID NO: 1121 - DNA, 500 bp, Homo sapiens
ccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaaatagggtttattttccactcat

SEQ ID NO: 1122 - DNA, 500 bp, Homo sapiens
ccggtcaggcccaaggaggcctccagctcggcctgtgacctgcctcgagaggtgtggctcctggagaccccacaggccgatgacttctggtgcgagggagaaccctatccaggtcccaaggtcttcccttgaagccactggcgcccaggagcggtgggccgaagacgtgccctaccctaccacaagggctgtgtctctaccccctagcctgggcgttggatctactggaatgagcagcagccgcttcctcggcagccttgggaagcacgggcgactggacagcagccgccgggcacggttatgggggcggggtgggcggggaggctagattgtttcctggtactgtcactgccactggggctttgatttggaggaatggggcaggggactatctgaagcgcttccatcctaaagccataatgaaaatatcttcctctcttccccattctatacaaaatactaagtggttttcttgctcccactccctaccccttagttaa

SEQ ID NO: 1123 - DNA, 500 bp, Homo sapiens
atgtcttttgcttatggcgacctccatacccaagggaatcagacagccatctctctccatcccatctgcctttccctgggagcctctcagatctggaggcagtagagggctgaggggtgggagtgggagctattcgtaaacgctcaattttcatctctgctgggagaggcaggtgccggggaatgcgttgatacccactttcgggtcagtgcgccacgtgccgcgggagattcggatgagagggatgggcgtcggcagccccactctaaactggaagggacctgggggtgggggcgcagggatccagggtggcagaagttcagaaaagagttactgctctttctcagacaggagagaatctcgtttggggtaaggctggagaagatgagtggggagggctttttttttttttttttttttttctcagagggattggaaggggagattttagagacgctgggaggcgtctggggggcctccgggcacggcggctggaggag

SEQ ID NO: 1124 - DNA, 500 bp, Homo sapiens
tcggctgggtgcccccacctgagctagatggacccatagggggccagtgagcaaggctggcagaccctcgcccagaggctggtggtgtttggtgcagttggggaggcagcagctgagcctgaccccaggggtcctgaggcacccatggcatgggcccctccccaggctcgaggaggcgctgggagattcgctgtccatggctctaccgggccccactcccaccgcccgtggtccggtcccgcctgtgcacgctatgcctccattaatattttaaagctgccaccgcacgctctttgcaggagggagtcattgtctgggttaacagtaggcttcaacaaaaacctggcgtaaggctgcaagaaatttgtttaagatttaacacatagtaacatcaaaacaaacaagcgctgccatggcaacgaggactaaacaaaggctcgcagataccccgagctggcgccacgccggtggagccatggcaacctgccctgaaaacagaa

SEQ ID NO: 1125 - DNA, 500 bp, Homo sapiens
tttttttttctaaatctgtgaatagatgctccagcccggttttctctgggcgcccctccagcagagtgtcagatcgtggggaggaggggctgtggatggaagcgagggactgtcgcctctgctcggagggggctgcggagggtgcatgtgtgtgtgcatgtgtgtgtttgtgtgtgcgcgcttctgaccctgccaggccagggctcaggtggcagccgcctgcagacctgtgggctggggaaggatgctcgtggcagagctgcagacagacgtagcaggctggggcccttcgtgtcacacggggagttggttggggtgggcccgatggcgctccctgtgggctggggcctttctttttggggtggccgcaccctcgtcagtgcctgtggctggaggaagccacatgtcgggggggattgtgggctcgtgcaggctgcgtagtgggtcacctgtggccaaggcctgagctgctgggacacgctcacgtcactgtcttcaga

SEQ ID NO: 1126 - DNA, 500 bp, Homo sapiens
ccctcccttccttcaccgactgtctctcgcagcagcccagacacgtttcggaccgggacccacgcacaggcccctccccggtcttggaaggcccttcctctgagaacaaagagatgttgggccagatcatcttccacgcttcttcagctccgagataggaacgcggtcccccaccactcacaggccggctgctcctcacccatccggtctcactgggacgccacgttcctcagggaagccagtcgggaacgttttttttgtttgtttgtttgtttttgagacggagttctatgttatccaggctggtgtcgaactcctgggctcaagcgatcctcccaactcggcctccaaaagtttacaggcgtgagccacggtgcccagcctcctgtgccttttaattcactgatgcaattgttgatccagccctgtcagccccgagggtagggtctgaggttgctgctgtatccctggcactcagtggaggcttggcccaaagaaag

SEQ ID NO: 1127 - DNA, 500 bp, Homo sapiens
ggggcggggcctggggcagatgcgggagggctgagtggtgccggcctgcctgcctgcctgacggcaccgtgtcccctgatccccctgaaggacaccatctctgagcttgcgtcatgcctgcaacgggcccgggagctgggggcaagagtccgggcgctgaaggccagtgcccaggatgctggggagtcctgcaccccagaggccgagggccgccctgaggagccatggtgagtgctgggtgggcggccacgaggccccggcaaaggccgggttggtggcaggcgtggcccagcgagcctgtcagaggcccaggtctgctccttccagggagggtggtggtgaggtcaccagggcgcggacccagacccctgagaaaaaggtcccgggcactgctggcgctgtgccctcagtccctcctgcggggggcagctcctgcctcggggactctggcaggtttcaaatgctcctgatgcattggtgtgttgtctgcctctgcccct

SEQ ID NO: 1128 - DNA, 500 bp, Homo sapiens
attttttacttcatggactaggagagaaaagctggcaagacagttttttgttgttttggggtgagtcggtagtaaacaaatcgtcccaaatcaatgcactttggatttggctaggtgagggaataattcacagtaatttgtattaggcctttctgaatatggctggatcacactggtgttaagatgaacccctgagcagacaagcatagagaattagtttgtaaaattgcggtgggggcaagcccagaccgcgtccagggctgccaccaaggagctggggggattcccaataggagctccgagcttcactttctcgtcttctccccgcgcccctcccgtcctgccgaccccaggtgtcctgtataaccagttcctgtcgcaagtggactttgagctgctgctggcccacgcgcgggagctgggcgtgctcgtgttcgagaactcggccaagcggctcatggtggtgaccccggccgggcacagcgacgtcaagcgctttt

SEQ ID NO: 1129 - DNA, 500 bp, Homo sapiens
cacacttctgggggcagtcaaggtgggcgggttggtgggccaggcggacgggcctcccccgtcatcagctccagggccccacggagcccgccggcagggggtgctgtgggcctgtggccttggacaagctcctggccccacgccaggatggctcctgggcactggcccagctgcaggcctggcggctcccgcctggtcagtggggataagggctaactcctagagcccaccccgaccccacacacacctcggacccacccacgtccccaccccggcctggacctccacgtctgccggccacagcctttcgtccacctccacaaaagcagctgtgtgtatgtacggggtgccctggcggcggtcctcaaattcccttcaggtggcagacagaacgagggtgacagtgaaaacgtgtccgcggcattggccctcggggaggaggcgaggggtccacccagcccgctaaaccctctccagggcataagccaggtggggcttct

SEQ ID NO: 1130 - DNA, 500 bp, Homo sapiens
gggaaattagggaggtcaggcaccctagtgtccactgggagtattaagttcctctgctgtgaaaaaagcttttggggggatttgactcccgaggggctccaaatggatgtggcttgtaagaaaggtccctggttataagagtgaagtgtgtaggggtgcgggtctggctgtgggtgttagggcgatgatgagagggccgggctgctggctgcgggtctggctgagcgggccgggggcctctcacctttgcgggccttgtctcccgggatgttctgggcccgcagccgttggtcgaggatgtaaagcatctccccgcccaagttcaagaagagcagcggtagcgtccgcaccgacatggtgctggaaacgagctggactggtgaagagccccggggttcggtagccagtggcctgaaggccaggccgcagcgtcccaatagtccggttgctggggcaacgccgtgacgggaagagcgagccaatcagaaggcggtttggtg

SEQ ID NO: 1131 - DNA, 500 bp, Homo sapiens
tcagcgttgtggatgaagtggcagcggggcccgtaggggcaaaagccgatggtgtggaaggtgcggcacagctccgtcttgtacttggggtggcgggtcaggctgcggagctcgtggatgccgtgtgcgaactggcacttgtccccgtacttacaggcaccgttttcctcaaaggggcggcacagctccgtcttgtagcggctggagttgacctggccgcccccgggctgcttctgggtgggcagcagccgctcgcccccttccgagaaggagcggtctcggaagcggctgtctcgcgagctcagagcgggggctggctcacccttgaggctgctgaggagctggttctggtggaacttggagctgggcagggtgactgagtgcctccgagggaagcccccaccagcaggggtgcccactgcctttctgtccagcaggcaaccccctgcactgggagcactatagttgagcatcttgttaccctggagagagaagagaaa

SEQ ID NO: 1132 - DNA, 500 bp, Homo sapiens
cgcctaacttctctacagatgggggcaacaccagggcaaccccggtgggctgctgggaggaagaggtgagatcatgtacacaaagggctgtgcggggcctggcacaccaagcacgctcgccaacgctgctgtctccaggctgttgctgatgtcatcgtcaggctccgttttctcctacctcctgggctgaagagctctcagacacgggcgctgaccccacacacagacctcctgggcatgggcaccgaccgccacgctgataccccacccagggcttggcgtgcagggcctggaccgtcaggcgagtcgccaggaatgctcttctctctactctcgacgcttcctcctcaaatcctcccagtttcaaatcaaacaccgcttctccatgcaccaaacccgaactccaccccctctttgcaccccgccaagaccgccgggggcttcagacggagcaccaaggtcagaggcgggctggcgagccgcgggtccgcgcccctgga

SEQ ID NO: 1133 - DNA, 500 bp, Homo sapiens
tcatggggtgcccacgatgtgccatgttctgggtgctggggatataccagtgagccggtgccctcctggagctcacattccggctaggagacagcaattagacaattaggactgagtgatttttgtaaaggaagagaaaaaagataaattagagcagagtaaaggggctgggaagcgcggggcgggagatgccccaggctggccgggcaggcctcgctgctgtttgaattgggcagtgggcggtccaggcggagggcacggactctgaaaggagagaagtggtgtttctgggggccacaagatcggggcactcttccggtagcagctcgctctctggccaccgtcttccccagccaaccaggcctcccggaggcggccggccagaaagcatcggcgggaccccagtttgccgcctcccctcggcgggacctagaaactgcgcggaaccaaagctcgagggcggctcgagtttgcggaccgcggggaggaagcgcccgccg

SEQ ID NO: 1134 - DNA, 500 bp, Homo sapiens
cactgggaaacccagcaaagctaaagctatgctggaggcggggacggtcagcggagaggtcccgggccccggccagggcacggcgctcttcagcgttgtggatgaagtggcagcggggcccgtaggggcaaaagccgatggtgtggaaggtgcggcacagctccgtcttgtacttggggtggcgggtcaggctgcggagctcgtggatgccgtgtgcgaactggcacttgtccccgtacttacaggcaccgttttcctcaaaggggcggcacagctccgtcttgtagcggctggagttgacctggccgcccccgggctgcttctgggtgggcagcagccgctcgcccccttccgagaaggagcggtctcggaagcggctgtctcgcgagctcagagcgggggctggctcacccttgaggctgctgaggagctggttctggtggaacttggagctgggcagggtgactgagtgcctccgagggaagcccccaccagcaggg

SEQ ID NO: 1135 - DNA, 500 bp, Homo sapiens
gtaggtgagcccaggaggtcatcggcgctcagaatagggggtggggtgatggacgtggggctgtccagcagcccggtggcagcggcggtggcagcggcactgggaaacccagcaaagctaaagctatgctggaggcggggacggtcagcggagaggtcccgggccccggccagggcacggcgctcttcagcgttgtggatgaagtggcagcggggcccgtaggggcaaaagccgatggtgtggaaggtgcggcacagctccgtcttgtacttggggtggcgggtcaggctgcggagctcgtggatgccgtgtgcgaactggcacttgtccccgtacttacaggcaccgttttcctcaaaggggcggcacagctccgtcttgtagcggctggagttgacctggccgcccccgggctgcttctgggtgggcagcagccgctcgcccccttccgagaaggagcggtctcggaagcggctgtctcgcgagctcagagcgggggc

SEQ ID NO: 1136 - DNA, 500 bp, Homo sapiens
gccgctcctgcgccgggtggtcgcccgcgaatccctgccgcgccgcgctgcgccctctcgtggcccgcctggtggtgcaactgggctctctgcgcagggccgcggggccgcctggcctcctcctgccctggccgcggtgccgcgcgctcgggaacgcgggcctttcgccgctagccagcttctgcctctcggccacctgtcctctctcgcccacgctgcctgggaggcgcgcttctgccgccttcttgccgcgctcgctctagcctcgcccactcctgcggccttacagggccgaacctcaccctgccctgcggaaggcaggcctacaccttccctccgcgccttcctccctgaccggcaccaaacaccacgttgccctttccagcatcgacgacctattccccagttctctgacaccagctgaattagcgcgaaactactggttaagggattagcccagggagactgccctcccttcgccagccacaagcggggtgccc

SEQ ID NO: 1137 - DNA, 500 bp, Homo sapiens
cgctcctgcgccgggtggtcgcccgcgaatccctgccgcgccgcgctgcgccctctcgtggcccgcctggtggtgcaactgggctctctgcgcagggccgcggggccgcctggcctcctcctgccctggccgcggtgccgcgcgctcgggaacgcgggcctttcgccgctagccagcttctgcctctcggccacctgtcctctctcgcccacgctgcctgggaggcgcgcttctgccgccttcttgccgcgctcgctctagcctcgcccactcctgcggccttacagggccgaacctcaccctgccctgcggaaggcaggcctacaccttccctccgcgccttcctccctgaccggcaccaaacaccacgttgccctttccagcatcgacgacctattccccagttctctgacaccagctgaattagcgcgaaactactggttaagggattagcccagggagactgccctcccttcgccagccacaagcggggtgcccag

SEQ ID NO: 1138 - DNA, 500 bp, Homo sapiens
aattgagagggccacctttaaggctgggccactgttactagagtacccagaacaataacacagtggtgttactttctgcaggttgttcagatttctctcttattccctatgtgttgctaaaaataaaaccacagcatataaatttcactcatctattggcaaactcagtgaggtagcttcacccaacattaataatttatgccttggaggtgagagtatcaaaagcaaccattatgtttccaggagtctcggctccggtaagcatctcttcctgtcgacttcatttgtgagcaaataatacccagtattaacggagatacaggattcaccagccttatgatttttatttttaccaggtttttggtagttctgaaaatggagtttattcttgtcatccagaaaacatagaaataaataatgaggcataaaaatttcatacatcttccttggagggaggaggaatattgtttagcttgtcaacattataataagtatatgaa

SEQ ID NO: 1139 - DNA, 500 bp, Homo sapiens
aattacctccttgggtttgtgggcaagcccttgcccacaaatacaaatgcttctggaagcatagttgcggtaataactaggaatgtagctttagttatgtatttagcataaataatattaatatatatgccttgtcaaatcaaatgcatttaataaatttgtatagtgtaatgactgtaattcctacatatagttattgtctttgagaaacgagtgaataaatatagctggcactaggcaggaactttccgaactgtgtcaaggttaatagtaagtaaaatgttataagtggaaacaggacagcaacagctgtgcaacattcttggaagcaaagacttttatagcatgaagtcagacagtgagcttgtttttgttgctcctttgggtgaacagagaatccttctaataattataaggaaaacggtatttttttttttataaattacaacagtttttcactcaatatctgacatctgcagctggaaaattaggggcctgtc

SEQ ID NO: 1140 - DNA, 500 bp, Homo sapiens
gatttgaaaaaccgctgaaggaaaattttcaattagaaagcagaacattgaagataaatgagacatgactataagttctcttcctggcgttagactatgactttcaggaaaaggaggtaataaaagtgtccggagaaaggtatttgtctgacattgtgtcagatttccgaaggcccatgagcaccttgagaagtaacagctgggaggagcagactgagagctttagcagcttttggaaagttgccattacgtctccttagctttcttaaaaagcattcatttggtgttgtcttttacttttattagcttaaaaaattttagcagattgtcacacaagccacattatgggagatattcccaattttgttgattacttttcaagcctttcttagtgttactttaattattctaaacagcactttaaaactgtttagataaattgaaaataagattcattccaaagaactgatacagaaaagatcttctctgagtcagaattt

SEQ ID NO: 1141 - DNA, 500 bp, Homo sapiens
tcttgtgcccctggtgaacttcaaatgctagtgtgctgggagccgtatgacagccccttggggtggcaggagctggcttgtgtggaggagagccactggcagctttcttggtgaaggggtggacagcactcttggtgtggaagtagcagcccccttgcctgtagctgggctggggttagtggaacagggtttagagaaagcaggggtaatgccgggtggttattttccccaaatgttagagaaagccagcgcttctggctctggaagtgaggctgttgggaagtgggagggggagcacagctctggaagctgccttccgtcctccctccattggctggagctctcccagcatttcatcggttcaaagccaaacacatgattttggacaagtcacttaaactctttgagtcagtttcttctcctttaagctggggaaagaggtggtgatttcacaagtggttgtaaatattgcagtaaagataatggaagtaaaagtgctc

SEQ ID NO: 1142 - DNA, 500 bp, Homo sapiens
ttccactgggttttaaaatgaaatcatagataataacaataacatttttaacacacggagataggcattttcaaactgtttttcactaaaccaaagcatgaaaactggaagacatgatttaaatagcctgttggcttccagaaaagggttcagggtctatgtccaaagccagacatagttaattcaacctcagcttcattcctgccgcatcatctttactgaaggcaacaaagaagggaaaaaatgcttcgggagttgttccacaggcacaggaaatcttctagaatatcaattgtgagggaaacattccattgaaaatagaaaaaactacattcagtgccaagtaaaaagaaatacaaaatgaggctgctctattttaaagatgtatctttgatgtgaatattttgcagagaacgcaaggtgactccacagaacaaatatcatcagcatgacaatgccataggagcaaaaatattcccaagtcagttgatgagtcgctg

SEQ ID NO: 1143 - DNA, 500 bp, Homo sapiens
gagagatccctcctgtttccccagcagccttccttttggtgtgtgaacaaacacaaccacgaagaacagcataattcagatatagcacaggcaagtgctacataaattcagacataccttatattatttgaccatcagaacaaccatgcactaaaaatctgccctaaagcaactagtctgttagtagaaaccggtcctggtacaagcaccagcattaaggacattccctctacttggttctaaaatctacggtggattttaggttctaaaagatgaagccaaatatagcaaggaagtcagacagggaagaccaaacgcccacccatcctgctttctccagtggagtgttttttttctttttccctcaacaatgagtagtcgatcaaaggtagattaaaagttggaggctgacattcctataaaattattggcggtccagccacactcccactgctctgcctctatatatgcagagagaaatgtttcaatcaaacaccaga

SEQ ID NO: 1144 - DNA, 500 bp, Homo sapiens
ccgatgataccttcttgagagtctcttaagaccacaaggattaatctttctgaactcaaaagtgaatcactacagcatattagctgtctggattgattccagtttctctgctttttcttggtggtaactgatgtgaggatctgttggtgcttagctgcctcttcctgttgctttaacctctggtattttaagattctctttagggaagatagtactgaccatctcagcacagagccgaaatgcacttagcgctgatgtgttgaccttagtggttgacccataaactgaacatttatacagttggaactcttgcggtcttttagccaacaaccataatgagtaacatgtggaacataatctttggtgctgataaatggctttttacgatgaaattgaccattccacgctgtggcttgggtgacctcatgtaactaattactgtttcttagctatattcacttttggaatttaaggggtaaatggtttctccttctgcaggc

SEQ ID NO: 1145 - DNA, 500 bp, Homo sapiens; identical to SEQ ID NO: 212

SEQ ID NO: 1146 - DNA, 500 bp, Homo sapiens
agttttttcatatttcattttgaagtgggaaaacctttaagaaaacacttgaattatcaatcttcagaaataaaaaaaaaaaaaacagtaaatcgctatataccacacacttttgctcttttaaaattaaatacatctctacccatcacacatgtacctctgtttcccttgcatgttaacacaaatcatgggctccccacctaggttcccttggtcacagaccaggtgagcagtcaagaaggccttacccgctggtcttcccttcggcagtcttttctcagcagtgtccccgagggcttcttggtccctagtgtgcaaaacctgtgaagaaaaacactggatatgagattcaaaaaaggagcaaacaaatgtcttctccttggaaacagcccattttgtccccagcggtccatggcgttgctctcccttgcccagtctaaccaatgtgcagactactgtacaacggcattgtcctgaacaggtagtctgaacactggggc

SEQ ID NO: 1147 - DNA, 500 bp, Homo sapiens
tgttactaaccataaatgaatgcactccccagaggatttggtttcatttaagacactgagagaccacaaggtctcagcctaccctgaactccacagaaaagattttttcctgaacctaccgagaatgagccatgcacagatgaggtgctgttattattttccaaaacgaaatcctttatgaagaggcatctttcatacaactcctgggaaagacggttaccgaaacagagcgctaaatcattggctttgcgagctgcacctggtcaatgtcactgtctcctatgaatccacttaccattcagagctcgtttgccagtattaatagaacaaataaaatggaatgggagataaagataccgacatagtgatttcttgcttcaggaaaaccttcctgagttacagaccaatacaatgttcccaaccacaagccagggagccaaagctgatataaacacagcatccaagccacagaacatgacttgtttaaggcttaattctgt

SEQ ID NO: 1148 - DNA, 500 bp, Homo sapiens
gaataggcggtgacactttttatttaactaaattctctaaggcccagcagcagcacgctaagtctgggaagctcgagacggcatatcctgttattaggagagcaccctacattcaactatcataatacgtgcactgtcagtgcagtaaaagaatgcagctaaagatttctgaggttttcccacacattttatagcctcctcaactccactccgggacagaattatatcaagaggatgtctgtgaatagccggtagcagcaaacatctgactgaaagcttagctgtgtcttacagcttccagtcggggatgtttacaacaacagactttctgaacaagaaatttaagaggaggaacagacataaatgttgccagtcatcatcttcagctaataatttatataatttctagtgctgaacaatagctgtgacatcttgaaacaaaaatgataaagttaatgctaataattaaagagaaagtggttcaccaagtgcaatttctc

SEQ ID NO: 1149 - DNA, 500 bp, Homo sapiens
tcattgcacaacaagggattcttcatacttgctatgaaatacaacaaggcgatttttgcagtgataaactccacacatgcatgataaatccaagcatgcaaaatgtttaacatcccagttcagagatactttagggacaaaatccgattatgaattatatgccacaataaatagggctcaatgtttcataaagcaatttatagttcataaaaatgacaaaatgtacctgtcagagagagcgcggagagccgttctctgagctgcctgctggaagaaagaaagggcagagatgtttatttaatattctgacttttgaattacgtgctcaatgaacacttaaaaaaaagacccctgcattacacacatttttgccatgtggccaaattttaaacgactagcaatgaagtagagagcactgttgtaaaatgtgaaatgtgtgtgatgaaatgaaccttcacggacagttaactgaagcccggcaatgcacacctgcaactagg

SEQ ID NO: 1150 - DNA, 500 bp, Homo sapiens
aaatcctattccagctaaaatatttacacagtcctatgtgtctcacttaatgcctgttaagcaatcgtcttttaaaactccacagacacttgtaaatctgtcgggagaattgtggcctataaacaaggtttcatataaagaaggctgcattgtcaattttgggggagtagggatttcttaggatgtgtttgaaaatagagttgaatatcagaaacagtttagagtgggtaacaaagtggccaatagtctcgcttgctggacgccgttagtggtattaacgggaagcctccagacactgatctcagctatttaaaactgtgctctcctgtaaatctgtcattgatcctacctctctcttgagttatggcgcagggacagtttctggtccagcagcccctggtagtctgcatcctagggcctgtcaggctagagatgatgagctgctggagcctttaacaggaggctattacgtggttatacgtaaagtgagtgtgtgtaag

SEQ ID NO: 1151 - DNA, 500 bp, Homo sapiens
caagtgtgggcaggggacaggcctgacttcagcaactgcaggagtctgggcagggtggggcagtatagtcgggatataacagaaataaaaccaaaaccccacagatacatacaaaaccccagccacaacccaaaccaaacaaataagcccttccagtcacaaaaacacatcggctcacgcttaccatcatgtaagggtcgtctacgatcgggtaaatgtaatctgtggtttgaaccaaggaaagcccaccgtgcctcaaaggaatgacacaagtatccattccaatgcctgtggagatggaagtcattagcatccaaaaataaaacgggaaagccatttcattttatatcaccagtgctctgaacaggaagagctcataagatacttatggaaactgcaggctgccaatgaagccatgtgtttcctatcaagaagcgtaactgaaataaacgtgaaacatatccagcttaggatggaaaataccaatgaaaatgttactc

SEQ ID NO: 1152 - DNA, 500 bp, Homo sapiens
aagaggtgagggtttcaggcagcctcagctcttaggaggcagaagatacagtttatacgcgggttgcggggggcggtccatttccatctccctgttctctccccaggccaatggccagggctaaagccctccttgggacatgtcaatagcagcaaacattttaaagatgtgacatgttcgaagcctggcaacaggggcagctccagctgtgcgagaacatggctggatttacgtctgcggcaaagcacccggtcacctttctctgcttggagtgcaatctttttttggaagccctgctggaaaatctgaatcttgtgagccatcagctgtttataatcagagaagcatatgtttaaaagagctgaggggccttataaactccgtgtgcaaattacctttggggctgcctgctccaccgcccctccctgaggctgccatcactggcgagcggctgagtgtgctgcacagaattcgctgtaaccctgttgtggcacggggtc

SEQ ID NO: 1153 - DNA, 500 bp, Homo sapiens
tcctggtggcaaatggccatgatcaaagagccagccacctccttcccgcctctgaagctccctccagccggcagatatttaaaagaaagcatgaaagttcagggagtgaacattccttccagattccttccagatgttcctttcagatgttcctcccaccatcctttgataattttttcacttcaaggaccatcttgtgttttcacctccccgtgtacgggtgctggctgacgatccgatcacatgagccgcgtgaaggctctgaatctccacggtgccatctccagtttctgggcatcgcgttcctctcaagaatgaacggcgatttcaaaggaccccaacactgggtgatggcgtgcaaagtgttaccgagaaataaacttcaagcagtgaagacagatggatgagatggagctgtgattgaacatgtctcagaggctagacatctaagaaacagtcgcagaggacaaagaacacattgatttttaaataagcaattc

SEQ ID NO: 1154 - DNA, 500 bp, Homo sapiens
ctattcttagcccaaaagtgcctctggataatcctctgggaatccctttttaagagtttctcacacatgaatccagatcctcgatataaaattaacaggaacatttctgaaatactccacttcctcccaagatagagcagccagaagctgacgctggcatccgcagccctgactgtgtcaagatccagtgggaaaattcactgtccaagtctctgaaatgtacggtattttcatctgcattggatcagacgcccccgtgtccttgtgaggtggcgctcccggaacaggagacagggtgggtctcattccagtccccgcttcagcagctgcaacagtcgggggtggataaaagacacctgcacctccatcttccaggcgtgttcatgtgcgcactggcccaagagagtgtctgtgctgagcattcgactgttagcaaagtcgtatctgccaccaccgaaggttggcttggggagtggaagaaaggccctgtcttgtagccg

SEQ ID NO: 1155 - DNA, 500 bp, Homo sapiens
tgaactgtgagaagtcatcagttgcacaggtgtagcaatgcactttgtattccgttggcttccccatgggaattggaagccgggggagggggggcggggtggggtctgctttaagcaggaaaatctgggttgtcccaacagatacacgatctggtgttactcgttttacaaaatttctttattgcacaaaataactgaagatcacggtccttgctgggttcccgggaggccggtgcttttcagtgctgccggctgcagagtgcatcacttcacacgccagctgggcttctggcggagttgtaagtcaaagttttgtaaattagatcgtattttagggaagagataaaagaataagactctgaatctttgagaaggatctgtgtgtgtggcgataatcagaaccggatttatgattcctgtaaagacaaaaatcagagataaatgtcaacaacgccaggaatcccgtgataattaattaagagcctatgtgtgtaacaggc

SEQ ID NO: 1156 - DNA, 500 bp, Homo sapiens
ggctaacaggaacaaggggaggctactgcctcacagggtcagcctcctggctcctgccaagaccctttagaaggtctgatatgctaatgatggtttaacaagactttgaggcaccgccccctcctgtatttgtgatgctgcagtcggcagtcggcagtccgaatctcctggctggctgtactcactgccgtttttcatgtttttctccagggtggaagaccaacacacacctccccagacagcccagcacgccagaaacggccacccgcaggccctgccagccgctcacgaggctgtctacagggagggcaagcccagcaccccggagtcctgcgtctcctcttcatgtaagaatgtgggcagcacactgggtcagttctgggattgtgatgtctagaacctacgcaaaacagcagcaggagtggcagacgcacgtctgctcctgggaagccctctggtctcagcaacagccccgtgtcacagaggctcacgggattccc

SEQ ID NO: 1157 - DNA, 500 bp, Homo sapiens
ctatcctgctagtttaggaagttattttccaacccaaatttaaatcaaagaagtgagtcaacctccccacctacaggctaacagtggctagggagacgtgcacttacaggttattagacagatgtctggggcatattcagcttacgggtgttggaaaactttcagtgtccaaaggagacccagcaccaggaaggtgctcctgagagctccagggaagcaggagcaggctgacctttccctcggctgcgccgccacgctgtgaaattactgcctatgagtcagactccggggagatggcacgggctaaatataacgctgggcaggctgtccgacgcgtcattaacctttttccttcagaacaaaggcggataacccaccgaacacaaaacaaaagtagcgcataatatgacaaatggccaacataatccgaaaataattgcagatctgaattaaactgtaagatgtgaattgatttcagctcgaagatgtagagagctgga

SEQ ID NO: 1158 - DNA, 500 bp, Homo sapiens
aagctcggtgctgtgtccaagatgacacaggcttgggcaaggccaagggccagtgaggggcaaggtcaagaattgaacccaggtctctcttccccgacagcccatgctgcagtcagtaaagaagcagcccaaatcagacgtagtccttatatggcttttctgatctagctgggagcaggagggggccacagagtcatcccgtaaatatttatcaaacactgacttagacatcgacgcttcggcggtgaacgagacccgcaggtctgcggtgtgattacactggaggtttctaggaagccgtgctcctcgggctgagtcttagcaatgagcaggaattcatctccctggcctgggccagtgaagcggggcatgtcggggtcatgggatgagctgtgggaacagcatgtgcaaaagcagggagcttggcacaggctgggagctgacggctgacaggctaagtcccgagattcatctttctggcagattctcctaaacacaag

SEQ ID NO: 1159 - DNA, 500 bp, Homo sapiens; identical to SEQ ID NO: 207

SEQ ID NO: 1160 - DNA, 500 bp, Homo sapiens
tgaacgggtgctttgtgttattttcttcttcctaactctgagaaattctgtgttcctctgataatgtgattggcttttttattcttagcgagcactgatttgaatatgcgtttgctgtctaaccctaactctcttttccttgccgtgcgtggctaacctcaccacttactgcagcatgttttctgtcggcctctattctccttgctcctttgctgaccctgttcctttgtttctggctgcgtgtcctggcggtggctgtgtgggcagccctcggagtacagcggccacctcaactccagctcccgcgcctcctccagggccagctcggcccgggccagccctgtggtaagtcggcctcctggccttgctcctactcagtgtcaccctccctcccccttcccttatcctcctcttccaacgtctccaaatttagaatattactctgcggtgatattattaggattacattgctcaacttttcaaggaccgtaaaagaaatt

SEQ ID NO: 1161 - DNA, 500 bp, Homo sapiens
actctgatcaatagtaatgaatcattgtttaactatgtgtgacaataactctttttcagctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccc

SEQ ID NO: 1162 - DNA, 500 bp, Homo sapiens
agcagatgcggagttgacaagctgacggctgctccatccttttcctctccagcccccacccctttcctgcattcaccagacaaactctgcgtattgccccacccccatcctccacctcctttcagggcatctgggtgggtctccctgggtcccttcctctgggagtaaggggtaggctggagggcagggccagattgcggcagcagggacctggaggtccattctgggcccggacctcttccaggcccccgccccccttcggagatccagagcgcagccgcgttctctgaccctcccggctccattcccggggggttacattcgactccatctgcaaacactgcagtggaaactaatggtcagtcgattgcgatttgcatctcattgaaatatcttccaaagcagccagagccttcaggcctgctgctgccgtcaagtcacctcggtgtccttccccgcagctcttgtcctcactggccgggcttcaccacctctgtctt

SEQ ID NO: 1163 - DNA, 500 bp, Homo sapiens; identical to SEQ ID NO: 347

SEQ ID NO: 1164 - DNA, 500 bp, Homo sapiens; identical to SEQ ID NO: 211

SEQ ID NO: 1165 - DNA, 500 bp, Homo sapiens
gaaatgagggagagagaattccatcaggaacaccctgcctctgatggttcccctggatgctgacctgaggaaatgggagaggagatctagcaaatcttcctgatttaaacacgtttggaatgtctaagcagaccactttagattttctccttggcccgacaaagagggagttacgaacccgcccttcctcgcgcgtcagaaatcctacccgccttcttcacagtacttgtgcgcaaaggacaggatgtccgaggcacgtccgctgccatcacaaatcaccacagggatgggaggctcttcttgcaggtattccaagacgatggacaccacgttagggcccccctccaccacgagacccacgaggggcacgccctgccccagtcctgcaacacaaaccacattcgcccataccacctgtgccctgcactgtccacccagtcgttttaactcctgaagtatggggaagagtaaaaacattacgacttgggggatgttctatc

SEQ ID NO: 1166 - DNA, 500 bp, Homo sapiens
acacttttgatgaagatttttgtttgattaaacaaagaactagaatgtgtttgggactagaggtggaataaaacattattttctcaggttgatttttcactcacagaatcaggaaggcattccaattcattgaaaggagaggcagagtgggcgaacctgcaccgggcacgcgcacatgtgagaagcgctgcctgtggccgctgggaggctgcgccatggcccgctccggagagctgcgaggtggctctgcgaggtttggctggagctgggcagcgaggcctgcccacgggtgggagagccgccgacccgtcatgtttgcttctcccgcgcgcagcctcatgggcctgcggtgagatttatggtatctattattgagttgtagatcagccgagatattgcatgtcagtgtaaacaccttttcacactcttcaccatataacttgtcatttttaatctcctacattgatgttaaacatctccttaccatcaaactgtaaata

SEQ ID NO: 1167 - DNA, 500 bp, Homo sapiens
aactctcactcttcactcttcatcccaaagaggcaaaaatcacagcagtgggctctggggcggggtggggtccccaggacttccgtgtcatcctggttgtgattgctgagctcctgcaacgtgcagccttgagtccgctctggccacccttcctgccgtttagagggctcagggtcacccgggtggcaacgtggctgggctgtccagctccgaatccccccagtgctgcacccgaacgcctccctcccacgcagcctcctgccgtctccgcaggttttaaatcagacgccgctcaggctgtgcccaggctgctgagccaaaagcgggatcagaaccacaaggaggaagaaattactgatggggatgaaagaccgaaataacttttcttttttaaaaccaaagatgctgatgggctccttgcaaggcagaggaacacacaggcagcagtgccgcaggcaggaatgctaggagtgtgcggggcttggagccagcacgcccgc

SEQ ID NO: 1168 - DNA, 500 bp, Homo sapiens
gataaacagatgggacggagagtgcaatttacataacaattaagctagtttagtacatccggcaatgctgctgaaagcaggcctctccctgggcgggctttccgtgttattaatctactttatgacccagtttccccaaatggataatttcgccttggtagtgttaagatgtatttagcgactcaagtatctgcagcagcgagagggtgggtgtgggagtcggtgaattgtctcttacgccttcctttccgggttttcctggagaaggctgcctcactgggtctttgcagttggcgtgttccccggtgccattcgtatctgattcatgcgtgtgcgaccagtactccatttcactttttttttttttgagacggactctctctccgttgcccaggctggagtgcagtggcacgatcgtggctctctgcaacctccgcctcctgggttcaagcaattctcctacctcagccccccaagtagctgggatgatagggcccgcc

SEQ ID NO: 1169 - DNA, 500 bp, Homo sapiens
ctgatgacaaactgccagccagctcccacaaaagcacgattaaaatgtcagcacaggatgacgaaggggccaagagggtcctcagagacaaactgtgttcagtgtgagttaatactttacagcagggctggggcccggcttgctgcgggctggccgggctgctggctcgccttgaagagaacaccagggcaggggctggcgactggcggcggggaagcatgtgcacatgcgtgtctgcactgctgtgtgcgtgtcgggcatgctgctctgtgcgggaagaggctcgtttcagaggaagcgtccaatgggccgttcaggttagggagttccgagactctccatgatttctgaaccgtgggggacggggtggtcgcaacctagaatgtgggctggagagcgctgtcccagtggtggccccgaggccacaggttctgtcccagatgttctcagcaccattttagcgacaagggcagctatgaaaatggcccagctgcagaaag

SEQ ID NO: 1170 - DNA, 500 bp, Homo sapiens
ttgtgggcgcgaggctcctccggaaagcaggcattgtgcagggtgtctctttgatggtcttttaaagagctttccctgttagctagagcagtttcaccttcagatagagctgcctttccgttgtccgtggaattcactgcacatttcgagggaccgcctgtcctggcagagagcaagggactcataaaagtgtcagaacattatgaacagcccgaagatgggctgtgagcggggataagtgaagcgcggcgtggaggccgttcggtaactccatccatctgtggacaggggcgtgaggacaaggcgaacagactcgtggcgagcagcacctgggcaagccagcaggtgcttgagccacggggctggctcctcgttgagctatctagaggagtgcaccgagcaaagcgcctgctgaaaatactttgtacctccgggattccttctcttcacttcgaagtgaaagatgcggagtttaatcctaacctagtggtgagagggtc

SEQ ID NO: 1171 - DNA, 500 bp, Homo sapiens
gggcgattctctcccttcgcgtgtgtgtgtgctggggttgtgtgtccttgaagcctggagccagggtgttctcggctcggtcctgtgatctgtgaagctcttgtttcttgtcaggttttttatttttcattaatttatctaaaattcagtcttcctgctttttagggttcttagacccgtcagcaagtgaacggaggagcgcgcctggtgtgtggccagccttgcgatgctgttgtgtttgcgtgggcgcggagtctgggcccagctgcactggcggcctgcacgccttggccccatgcccacggccacggaggctgagaccagggcaggggctttagtcccgatgggagcgggggcagggccttgtttattgtttttaatcgcggcaaaaacccacaacattaaatttaccaccttaaccgtttccgagtgtgcagttccttagtgctaagtacattcacgttgttgcacggatctctagaacttgttctctcgcaaaa

SEQ ID NO: 1172 - DNA, 500 bp, Homo sapiens
ctcagtggcgggacagcggcgtgggtcagtcgcctcccctcctgccgggtcctcagtggcgggacagtggcgtgggctgatggcctcccctcctgctggggcggttgcgtgcgtcccacgaggaggtccctggacccagagggcagggcatgggggtgctcagagccgcagtgggcgattctctcccttcgcgtgtgtgtgtgctggggttgtgtgtccttgaagcctggagccagggtgttctcggctcggtcctgtgatctgtgaagctcttgtttcttgtcaggttttttatttttcattaatttatctaaaattcagtcttcctgctttttagggttcttagacccgtcagcaagtgaacggaggagcgcgcctggtgtgtggccagccttgcgatgctgttgtgtttgcgtgggcgcggagtctgggcccagctgcactggcggcctgcacgccttggccccatgcccacggccacggaggctgagaccagggca

SEQ ID NO: 1173 - DNA, 500 bp, Homo sapiens
cctttggtgccgttttccattagctcctcctcccgcagggcgtggagagcagccggttactcgagggtagggcgtctagagcagccggttacgcgagggtagggcgtggagagcagccggttacgcgagggtagggcgtggagagcagccggttacgcgagggtagggcgtggagagcagccggttacgcgagggtagggcgtggagagcagccggttacgcggttacacgagggcggagggcgtgtgccgggagcacaatccgggccgaggctcctggtaagggagcagagcgggaagctgatcccccacggattcttagggggccgacttcccctgtgttgaagattcatcaaagactgattcgagtctgtgttcagcatgtgtgttttagattagaacagtgttgagaatttttatatggggcccagttttagcaggacatcatttaggatctttacaaacgagttcagggtacttcgttttatctgttgtctttga

SEQ ID NO: 1174 - DNA, 500 bp, Homo sapiens; identical to SEQ ID NO: 228

SEQ ID NO: 1175 - DNA, 500 bp, Homo sapiens
tatcaaaggtaaatttcagtgctatatatacatttcgtattggaggctcaggggtgagcctgcgatttttgtcataggacgttagagacacaaaaacattttacaaagaactttgcttttagcttgcattgttttgtgaatatgaactgatgcaaagaccacgtgtgtaagacactttatacctgaataaccaatgaaaggccatttggggctccatattaatcacaaacaagaaaacccactttgcttcgttaattattagcagttcttactacgaataattagaagggaaaccagatgcccttctcttataaacaagtgtctatctaaatcaacgaacctgtacagattagaccctgggtgaattcatgcttctcaaaaaccttgtgtttgacttcagtccaatagctcagtctaccacacttgtgaatctcccaaagaacgaaaacaaagctctaagttttttttattcacaagagggaaaaccaggactatttaga

SEQ ID NO: 1176 - DNA, 500 bp, Homo sapiens
tagggcaggtgtcctggcttgagtgactgtcctccaataatcagagctcaaactaaacatcgtatgttttacttttggtttccaggcaaggctgagcagggaattttcagttttccctgcccagatgggtgttttttcctgaaggcatcatttattgtgtagcgaggagacagggctggctgtggcagggatagtctagaactgtcctcattgctgctgttcctaaatagtatctttaccaagtaataacgtgccgtctttgggaataagtgctttcctcttagcctgttctgttttcttgggtgcgctaagtaattgaactggctcaggaagtacctattgtggtttggcagaggtgactgtcacgccttgtgactccaggggccagcactgctgggatcctggctagaccagacagagccttggtgaagtgcttaggctgtctgcacatcgcgaggaaggtggtattcacttcgctaagctccttggcataggcagtt

SEQ ID NO: 1177 - DNA, 500 bp, Homo sapiens
gatgcctgaaaagttaatcaacgaaaggacttaaatgtccccattgaatttaggaacaaagaagtaattaatgaactgggcaaaaacactcaatgtaccagcgttatcgatttagaaactgaaactaagtatatctgatgttgcttttaggaaacaagtaaatgaggtcctaaaaagttaaactgtgaccatattttctttcctttttctaatttctccttgggccatttccaaaaagccctaataccccgactgatagaaatggataccttgctgtgcactggtactactgtgattcatggaaagctgatcatgcaacccaagacgccaaaattcccagccttactgttacgaaagaaagtttctaagcacaattgtctctagccaacttcctcttagtaagaaagaggccaggcagggcttcatgcagggtacagccctgagtttcttactgcgtggtaagtttctggggctgggagtaaagcagcgtgaccgaaagc

SEQ ID NO: 1178 - DNA, 500 bp, Homo sapiens
aaattgtctagctatgttgtcctgtgtttcagactttgttactttgtctcagtggaaaaggatgacagtattactggataaaaacatttgcgaatctcatgtttgtttcccaacaaaatgctttgatattcataggcataggggccacctaagaataggcagaatattcgtctcacagttacttttcagagcggagttcttcagccctgaacaaaggacacagcagaaaggaaacacagctgagcaaatcgatggaacaaaggaagcattcaactcacaccttgcgtcatacacgcacaaaacttcagctatctgtagaagccagaaatgatgatgaaatttgatctgtttaatcttgtaactatgaagttccacttcctattttttgcttctgtgggaggtgaggggaagacacacagtagaacttaaggagagaagagaacgaaggaaattggtacgatcacattgactttttcagaaaacactgcgcaggaccagat

SEQ ID NO: 1179 - DNA, 500 bp, Homo sapiens
ctacacatctgctgctctgtattctgacctacatctgcatactgctttaatagaatggatgtttgcagacgtgactgtgatattggaatatggaaggatccatccagggtcaggaagcagcaggctggcttcattctcagtgtttgttttctgggtctttgaaggagaggtgttgcagggaaaaaggtcgtgcatcaggaagtgtcatttaaaaaggacctgagttgggctgagttatcagcaaatacacgccatggctgtgctccccaccccccaccgtacactagcagggcagcagctctgattgtctaacgagcagcagagccgcccagcagcaaccacattaggaaggaatcggaaaccaacgctccgctggctgtcaccccttacccacttgctgtcaggtagagtacttgtttattattaattatctattttcagtatcctgcacctgggggtgaacatcatcggtgctaagactttttagcctatggggatct

SEQ ID NO: 1180 - DNA, 500 bp, Homo sapiens
cattgtgaaaagctgggccagcgcttccttgtcgtaatttttaactacctgttataaaatttatgggtgggtttgtgaaaagaaacgaggtccctgcatccggcctagggaactgcttttcttactatggaggaagtctggggaaggcatgaggtatcccctcttggtcagggttgaggcacccaaccattgagattcccatgccagcttgatgcgggaccaagtggagagatgccggccttcaaatctcgagcccgtggggagagtgacctgcctgcaacccctcccccggcaaatagtctctatgggggaatttattctggactcaccttcaaaattaggggtctggaaaaacaggctgctcgaaattttagcacagaaggtggaattcagggcagtaaaaggttattttttcaggcctcggtagtacatcccagctgcccagacattgaatcaggaaatttttctgagaaaggcaggtgggtatgggcaatctgaca

SEQ ID NO: 1181 - DNA, 500 bp, Homo sapiens
gaaaagctgggccagcgcttccttgtcgtaatttttaactacctgttataaaatttatgggtgggtttgtgaaaagaaacgaggtccctgcatccggcctagggaactgcttttcttactatggaggaagtctggggaaggcatgaggtatcccctcttggtcagggttgaggcacccaaccattgagattcccatgccagcttgatgcgggaccaagtggagagatgccggccttcaaatctcgagcccgtggggagagtgacctgcctgcaacccctcccccggcaaatagtctctatgggggaatttattctggactcaccttcaaaattaggggtctggaaaaacaggctgctcgaaattttagcacagaaggtggaattcagggcagtaaaaggttattttttcaggcctcggtagtacatcccagctgcccagacattgaatcaggaaatttttctgagaaaggcaggtgggtatgggcaatctgacacgatcc

SEQ ID NO: 1182 - DNA, 500 bp, Homo sapiens
agagccagaggggggcagcgcagcgcctttgctgcggccctaacagctggcaatgccaacccaagggagagaccctgtggccatttcatccccacccccaaattaggctccgcattgtgaccttgaaaggccagcttgtaagagagtgaagtgggaatttgatagcgcctagacataggggctgcccgctctgagaccccccccgccccagcccccactatctagggcatccagtggacaattaggcttcgtgagccccaattccaaatgcttggatacgctaacattttaagcatttctgtctgtaagttaaaacgaagagccccaaagagggtgttaatgtagatcctggcaaactggaagcagcaaagttggtgaaccagaaaggaagtcgccttggataagaagcccatcttttgcaatgccatacttgtttcctttttgaaatgaattgaggtaaaataaccgtttcaggtccatcccttacatggcaaagtaaa

SEQ ID NO: 1183 - DNA, 500 bp, Homo sapiens
tttctctccttgttcaaaaaccttgtcatgaagcctccgagatgagacatcagccagggaggactagtcctccatttcccccaacacccaggcgggtatttttatttaatatctgcataagcaggcggttgcttggtgcctgcacgtgtcgcccagtggtggggaaagcagaagtgtgtggctcaacggctccaggcgccttctgggatacttggttgcctgttgttctgggtcacagcaatggcattgcggccagggccgtgctccggcagctggcttagagggacagatgggtggggctgggtgagggtgttctgctggccagcacagacactttcaaccagggtcccaagaaatcaggaaaggggggtggctctgggaattgtaaatagtggcgggctctgctctggaagggaacattgtgagatgctggccctgctgtattctacggccctctctagggagcaaggaagcagtggggagggatttagtgatgtgct

SEQ ID NO: 1184 - DNA, 500 bp, Homo sapiens
tcctttcctggtgcccttttctgcagcctcccctgccaaacccccaccttaattctgcacggtctctctcttctgcccctaggagagtgtttggcttccgggattgggacctggaggagcatttagaatttggtaggggcaggaggagagcagattggcttccctgcacctctgacccacctggctagagggtctggcgcttccctcacgtccgggctctcccctcccccatccagccatggattttggcgttaaaggggccctcgctccccaggagccaactgagtctgtgttttgccggggagaaggcgtctggatggtcacgggtaccatatacaatagtcacattgactatgacgtccttcaagtgggaaaagcccttcaacatgtaagtgtttgtaagcaagaaccggctgctactgagagttttccattttgttccagattcgcctccacagatatcaaaagaaacctgaagagcctacaaaaaaaaaagagat

SEQ ID NO: 1185 - DNA, 500 bp, Homo sapiens
gaataaacgagttttttctcagcatagtcccgtttatggctttattgctacccattgattactccgctttgttacacagaaggaaaagatcataaaatccggcgacatccgggttcttgttatagccagctttccccccccccaacccacccaaaaatggtggggggggggggatatgagctttctctgctccccgcacactccccaccacccttctttgtcaactcaaggcattttcagcctatatcacgatatcaaattaagtttggactaatcaggagaaaacccccatctgcacactttccgctgtttcagttcgcctactgcggctccctcacaagcctcggattcagctgccttttcgtaaccgtctcttccctttttttagccccaagatgggggaataaaatgggcgttgaggttgctgagaggcccatccccaccacgggtgactggcacttgggtgagagctccttagaacccctttctgaagtctccaa

SEQ ID NO: 1186 - DNA, 500 bp, Homo sapiens
tgagagaggtagtgagcgtcctgaagggctccttgagggacccttggataggcgagtggtttggtctccccagtcttatcttccccagataagatgccctaatgactgcctgctggctgggaaagttaccccgcccaattagggagaattcaggacaggttgtgccacagtctagaagtaaaatttccggtgagctgcccgcagcgccgtcccattctccccgctgcccattgtgaaaagctgggccagcgcttccttgtcgtaatttttaactacctgttataaaatttatgggtgggtttgtgaaaagaaacgaggtccctgcatccggcctagggaactgcttttcttactatggaggaagtctggggaaggcatgaggtatcccctcttggtcagggttgaggcacccaaccattgagattcccatgccagcttgatgcgggaccaagtggagagatgccggccttcaaatctcgagcccgtggggagagtgacct

SEQ ID NO: 1187 - DNA, 500 bp, Homo sapiens; identical to SEQ ID NO: 279

SEQ ID NO: 1188 - DNA, 500 bp, Homo sapiens
aagagaacactcaaaggctgaggaattctcagcggtaaagctctgcccacgttaagtaacaaaggataagttagtctttgttgtgatcactttgttgtactgataagctacgtatttctactcaaggattcaaattctcacctttctcaagaattgggccaaaaccgataaactaaacttatttacggtccactgattaaaggttgttgcataataagttcttgctatgttcagcagttggattcacagcgccagaaacctataactgcttgactttcctccccactacactgcgaaaattgccccttaaatgtaactaaccctaaaacctcaacagtatcgtggccaggcgtggtggctcactactgtaataccaacattaggcataggcgaggggattgaggccaggatatcgaaactagcctgggaaacacacggagacccggtctttggaaaaataattagccttgcgtggtggtgggcgcgaggttccggctaat

SEQ ID NO: 1189 - DNA, 500 bp, Homo sapiens
agtgcagtggcatgatctctgctcactgcaacctctgcctcccaaatgctagcaattctcctgcctcagcctcccgaatagctgggattacagccacgtaccaccatgcctggctgctaattttttgtatttttagtagagacagggtttcaccatgttagccaggctggtctcgaactcctgacctcaggtgatccgcccgcctcggcctcccaaagtgctgggattacaggcataagccacagcgcccgaccatatttcaaggcctttttgctccacgtgctggttgccctaccagaactaaacggacagaactcgttgctcagagaagtagagacactttcctggagtcacacagcaaaggagaggcaaggccgagggttcccccctctaggtggacattgggttcctgttgcccgccgcttggcaccgagagggcctcagggaatcacatgtccgcctggcctggcctggtaccaaatgtttatagacaggacgag

SEQ ID NO: 1190 - DNA, 500 bp, Homo sapiens
gctttatttacacttttttcagagcaaaaatacatatatgttggtgtgggtggggatgtcccggagtacgtgggggcgagggtgcctgcgtgcctcctgatctgcaaggatctatctagtgtgtgtgcctgggagtgtgtgtgtgtgtgtgtgaatgtgcgcgagtgtaagccctgctgtcggtcccgccggtggctgccctctgcctcccccgcacactccgcgcattgtttgggactgtcgggaagacgcctcgcacctcacaaatcatttaagcacctcagtctgacgcctgcagtcattaacaaagtaatccattaatcttcaaagttttgacacccgagggccctgcgtcccagccacataagttctgttaaagcaggagaaaggagcagaggaagagaggagatgagagagggagaataaagagagagggaagaagagagagtttgagagatggagaaagagaagacagaaaagagagaagaaaggaaagattt

SEQ ID NO: 1191 - DNA, 500 bp, Homo sapiens
atttatttattttattatatattttcttttaattcaggaaatacccacagcgattacaattctaatttgcagggaatcctgttggcagaaaaatcaaacaattaacaatccaccttctaaacagactactggtaacggacgacttcagaggcagccagtcagacacgagcgattgcgctccccccgcgcctgggctgccttggagttcagatgaaaacaagttcaggaagttgatttgatgggcagcaccgaccaaaccacgacttatgaggcttgcagatgcatgtcagaattaggctgctatgaaatacggcgtgatctgttccaccttctgtaagtttctcagaagtgaggactctactctcagaaacagcgtcctccctgccacagccatcaatgtgcatgtggtcgacacacgcattcacacacactcacggctcattaaaatgcgttgtgaacttggcgtaatccccaggatgtttcttcattagctattttgg

SEQ ID NO: 1192 - DNA, 500 bp, Homo sapiens
cctaacacattggcaaataaaaactgtactaacaggtgagactgtggcccacagacactgcttgcagcaggcagaggatgtgggagcctcgtgggaacccccccgacttgtccactgaagtaacagcagcaatgaccttccctcgggaattccacctctgcgtttttccctccaggtacgttcacggaagtggcacactgcatgcgtccagtgagtcaatgtggcaccgcctacatgcgtgtcactggccggtgggacattcaaatcattcatacggggtctaaacgagacagagcgtggccgagacaggaaagacaggaagcgctgtgctgcttggaaatggtccaccaggtgcagcagtagctgcaagaaaggaacaggaagaacggtgtgttcaaagctctaccatttgtgtagaaaagggagaaaaacacgtttcctttgtgtgtgtcaaaggcatcgaatgtctggaatgatccagcaccggctacactggttga

SEQ ID NO: 1193 - DNA, 500 bp, Homo sapiens; identical to SEQ ID NO: 508

SEQ ID NO: 1194 - DNA, 500 bp, Homo sapiens
acaattgatgtgttttgattccctaaaacaaaattagggagtcaaacgtggacctgaaagtcagctctggaccccctccctcaccgcacaactctctttcaccacgcgcctcctcctcctcgctcccttgctagctcgttctcggcttgtctacaggcccttttccccgtccaggccttgggggctcggaccctgaactcagactctacagattgccctccaagtgaggacttggctcccccactccttcgacgcccccacccccgccccccgtgcagagagccggctcctgggcctgctggggcctctgctccagggcctcagggcccggcctggcagccggggagggccggaggcccaaggagggcgcgccttggccccacaccaacccccagggcctccccgcagtccctgcctagcccctctgccccagcaaatgcccagcccaggcaaattgtatttaaagaatcctgggggtcattatggcattttacaaactg

SEQ ID NO: 1195 - DNA, 500 bp, Homo sapiens
aaattaaaacatttattatcaatatgacagagaaggtgccgctaaaatagacaataggtttttggaagaggtgattaaatggatgcaaaatttatggattgtttattccgtctacctttgctgtgtcccctggttgtggcatacacacgtgtgggtataaaatcgtaaatcctatgtagtcgcgtagtgcatgcgcagaaggcttagacacgaaatgtcatttcagcaatgtgcctagagaagctctgacgccgccttggaagtaagtcgttgctgcctgacctttgggcgtctgggacggatgcctatacctgcacccagcagcactggaaggggcccaggcccttcgcagcacagcctatccccagaccgcttagtccttcataacatatatctccacggaaaagggtatttcctcccgtcagaaaaagcgccccagtctggtctgggttggtttttatttcacgttgttgcaagtaggcgaagtcccttctgtctcc

SEQ ID NO: 1196 - DNA, 500 bp, Homo sapiens
cgaagagccccaaagagggtgttaatgtagatcctggcaaactggaagcagcaaagttggtgaaccagaaaggaagtcgccttggataagaagcccatcttttgcaatgccatacttgtttcctttttgaaatgaattgaggtaaaataaccgtttcaggtccatcccttacatggcaaagtaaaaagctggagtcagtacacagtgttggggtgggggcagcgtttgggggcgacgagttttgtgcaccgcgctggagtaccctgcacataaggtccgctcatgggcttctcagtacggactcgccggcgggaacaattaattgagcaaagcgcccctttctgggctggagcaaggttcgcggctgcagatatctcaagctgaaggcaagagcccaggcgaggcgcaggcaggccacgtggctgttccctgctgagactcgcagctttggtcttggaaacctcagggtgtggagctgcttgggccgactgaagggttca

SEQ ID NO: 1197 - DNA, 500 bp, Homo sapiens
ctaggaaaaaggcgagcgcagaggaaaaaaaatctatcatagaatatcgctgctagggtgttttttttctaattcactgattacagccgtatggggaccgcgctactattaaactattgaattcatggagacaaggttgaaattggaccgaattggctgtcacatgattgcttctgcccaatgacaatttgggctttaatcaaaagaagccactgtctgtttgattgatccaaaaaagtcgggaaggaacgcctcattgggggccagcgaggctttatttacacttttttcagagcaaaaatacatatatgttggtgtgggtggggatgtcccggagtacgtgggggcgagggtgcctgcgtgcctcctgatctgcaaggatctatctagtgtgtgtgcctgggagtgtgtgtgtgtgtgtgtgaatgtgcgcgagtgtaagccctgctgtcggtcccgccggtggctgccctctgcctcccccgcacactccgcgcatt

SEQ ID NO: 1198 - DNA, 500 bp, Homo sapiens
acctatccaagtaccagctcacatggagctgagcgcacagtggtctcacttcctcccatccaggcctccaattcctaccttccaggcctccgacccctgcaccatgttgcaccagctgaagcccctgccgcccaccgctcggtggaggatggtggggagaacccttcccctaaacgcctcataaactgcccggctgcgctggaagcccggccaccttttactgctcagctcgattacacaccataaacccgacctcacaatggaattgccccggaaattctcctgtaaattgtagagtttagttccttgtgtactgagcacttcccatcactttcagagggtccaggccgtccccgtttaccgcaccctctcagggggccccaggaatacaaaaggtggagggagggttcagatcgggacgccacggagccccagttcctgcgcagtgaaccaccggggcttgggtaggaaggcgggggctggtggggcaggtgggcgct

SEQ ID NO: 1199 - DNA, 500 bp, Homo sapiens; identical to SEQ ID NO: 794

SEQ ID NO: 1200 - DNA, 500 bp, Homo sapiens
aaaggatgggctcgtagacggttctgggggctcgggcctccaggacattcctgcgcctctggagtggggatgcggtggaccttacccactcctctggggctcttctatggctgctgggcactttcaccggtctcagaccctgcaatcagcaacagagcatttcactgtgcctgatgccgctgagcagagctggcaacgaaaccaaaacttcggggacagggtggagagttccccgtggtgcgggattcccgagtgtggccccggctgggggagggtcttgggcgctcattacaggccaggaggtccgctgctggcgctggcacgcttaattcttttttcccacattgcagaatcattcccaccagccactcggagagtggtgggaatctgtcttggtttaatatttctaaaatataagtttcattgtcccccaggttagcccagccaggactcattgcgcagtcctcctcgccttcctggaggcgccgcaggaagcggga

SEQ ID NO: 1201 - DNA, 500 bp, Homo sapiens
gtgaaccgcagtcgtccgcccagtgggccctcaccggttgctcccctgcctgcaggctccgtgcttggtatctcagaaaaccttcccgaggaaaaagcccataagggacaagtcccggcccaacttaaaatcacatcagactgctttccagtagaggagcaaggtcgagattccggcccagggaaatcaccgcaagccctgcgcattgttcagaccccttccccctttgccacttcccgccccccaccccgacctccgaccgattcgcagcaccccacccccagtcggggccatccatccacctgattaactcgccggcagcaactcccagcgtagaaagtagggcaaatgaacacacacagtcggtaaagcaggaagccacagacctggccaatgcacccaccctgttaccaaccccaccccgctgcgcagggggcagccggttcttgatgtggcatttccactccagggaaatagacagcttcctgtaataatgcatg

SEQ ID NO: 1202 - DNA, 500 bp, Homo sapiens
ccaggagctgcccacaagcaccccctacttccaagacccctgttcttgtctcaacccgcccttctatcagggtccctacactccacttctgcccagctcctgtccagctgtgagttcacttgaggcctctcccgtgaaatctgccctctcggtctgaggtcagggaactcctgtaagacgcaaaaggcccacggttctgagccagtggcctccgaaggccggaatccgctagccccgggtctggcagaacgtcacttgctgcgccctaggcctcttcccgccacgcttagagagagggactggaggctcagaagggggaagagaaggtaacgcggcagctgctgggtggggacggtgactgtgcccctagatcgctgcctcctgggtcctgaatcttgctccccgctccgtagagttcccgaaaccccgaaggctctcaagcaccgcaagccactcctaacctcccccacgccattccccaagggcactgtcccccgagg

SEQ ID NO: 1203 - DNA, 500 bp, Homo sapiens
tgcgtatgcctcggaccgggagcttcggtccctttggcggggtctttggcctctaggggcctatctgggtttccttcttggtttggtaagagcagcagtagcgccaggtacgccttggagactgtaggcggaatcgctccagctcctgctctctcccgcgccccagccccgggcggagggaacaggtgggaaccgcgggctggaaggagggagacgtcccctacctccactccggaagcctcggggtaacgtctcccattgctctagcggagttcagatctccaattccagtttcaactggaaccctcaccgggtctgtctgctcagttaggagggggtgcgtttgcattgattttttgtggcatctggaaatttgcggtgtttcaggaataaattttagcatgtttttcttttctgttagccactgccctccgtttctgcattttgttttttaaaatattaatgactgtgtatgtctctgaaaggtccacccaactcag

SEQ ID NO: 1204 - DNA, 500 bp, Homo sapiens
caccatgttgcaccagctgaagcccctgccgcccaccgctcggtggaggatggtggggagaacccttcccctaaacgcctcataaactgcccggctgcgctggaagcccggccaccttttactgctcagctcgattacacaccataaacccgacctcacaatggaattgccccggaaattctcctgtaaattgtagagtttagttccttgtgtactgagcacttcccatcactttcagagggtccaggccgtccccgtttaccgcaccctctcagggggccccaggaatacaaaaggtggagggagggttcagatcgggacgccacggagccccagttcctgcgcagtgaaccaccggggcttgggtaggaaggcgggggctggtggggcaggtgggcgctgggctgtctcctcccgggccacggaagcctgggggtaggggtgtggagtgagggacaacatccggggacgcctttatggcggatcagatgataccttgt

SEQ ID NO: 1205 - DNA, 500 bp, Homo sapiens
ctcctctccaccccgcgaggaggggcagctccggagacccggtcttcagcgagcggggtcttagcgccggggaggtctacttccttttggggttgccattttactattattattgccttttttttttcttcaaaaggactggagactgatgcatgagggggctacggaggcgcaggagcggtggtgatggtctgggaagcggagctgaagtgccctgggctttggtgaggcgtgacagtttatcatgaccgtgttcaggcaggaaaacgtggatgattactacgacaccggcgaggaacttggcaggtaaagggggtaccagaagcgtaccctcctggattgtggaaatgcataacgatggggccattgggtggtaaacaaatgcagtttgaatcaggcgtctccctcgccctttctggagatgcgcaaatcatagagaaaagagttactaacccagcggtaaaccgcctgatccaagggcctgggggtggaggagaggc

SEQ ID NO: 1206 - DNA, 500 bp, Homo sapiens
taggtcgtgtttgtaaagcacttggaagacaaaacgcgccccaagtgttaattatcattagccccgtcccaacacgcttcccgagcggtgcggagagccaggagtgtcccctagccaacaggcggccgggtggaacgcggggaccgcagccagaccgcgccccccacccctgctggctcagatccctttcccaggccctccgaaaattgggacaccagggcagaaaggggtagggagagcagcggggcacgagacacagctaactgcaggtgtatccgtccccctccgggtaagagagaggggacgcccgggaaggcctcactcaggagggcctccagtgttggggaaggagtcggagtccacgcagcgacctggggcgagtcttccggggcgtggacttccctaagcaccgtgtcttcctaaatctctcagggttttccccaggcagactccagaagctcgcccccatcgactaaagacactattgcccaatccagatc

SEQ ID NO: 1207 - DNA, 500 bp, Homo sapiens
aagtgcgtccagggagcgccttcggagggacgcctgggagcacggtggtgcacgcagcttctatcactggctccgaccctccgcacccagagtctaaaattgtccccaatttcgcctgagtggatgctccgcgttgggtgggggtggaagaaaatggaggtgagggttattttaggtggccgaggtccgggcagggtctgctggcagaaggttgtgctgggccgggcccaccttccccggctagagggccgagctgggcgccgcagaccccgcgtacccaggccgcccggtactgcccggagcggagaccggcctctgctcgcggtccccggcaggcgctgaaggaagaaatcccagggccgatttgggccgttgagagagagcattctgactctgaaagcaccccccccacacacacccccaagcccccaatccgcagaggaagatcctgggcgaatttgattggggggcggggtgattgttacagcctcaacaggaag

SEQ ID NO: 1208 - DNA, 500 bp, Homo sapiens
tgcctggagttgcggggatggcattggtaaatgactctaatgcccaaagaaaaatattacaaatgccgctgtctcggccaccaatcgggcgccgctttcctgcgcgggcgatggctcctctctggcgcggagggcacccacatttgcatgataaattgaccagactggcggcagccaatgaaatattcaaattaggctgggtggcggtagtaggggtggagtccctggggctgccccttggcgcggcggcgggagcgggcgctaccacctctccgtcagcgccctctggaggcgggacagcgcgggcggccgctctggcccaaaagacgagatggggggttgggggtttgggatgcaagggggtttgggaggggtgatggtggggtctgggtggtgcttcgcggccccaggaggctttccggctggcctcgttgactaggcgtacagcagcgtctccgcatgcctcttgcccttaaaagtgttgatggattgcagaagtg

SEQ ID NO: 1209 - DNA, 500 bp, Homo sapiens; identical to SEQ ID NO: 281

SEQ ID NO: 1210 - DNA, 500 bp, Homo sapiens
gaactcgatttttccgcgaatcaatgtctgctttttggataccgtagatcagggtgtaaagattgagtgtgatgacaatttctcggaagatagggacgtctgagctctggaagtaccatctctcttctctatccctaccccctcctccagccgcctcctttcctggcgtggctcttttcccgggagctttccagttagaggctgcacacctgtccgggcgtgtcccgggatttgggtagcaggtgggggcggctgaggcgacatggaggggatggcgggttcagggcctgggaaccccgggggtgaacttcctcaggtgacgtctgcggccggaggcccgcaccgagtgcacgtgtttcacacacgcgcgcgcgcacacacgcaccagagcgcggcgaggagactgtccccctccattgcgtttcacagcggctccgggaccagtgtggcctgtgagccttttgtccatccgggcgtgggagcctggcctgggaacaggg

SEQ ID NO: 1211 - DNA, 500 bp, Homo sapiens
gtctgtccgtctgtgggcgaggcctggagccacaaacccaatcactggactgaatcaccccgcggagaagaaaagaaggcggagcctgccgacctggaggcggggttttgtcagagctggggcggtgcttatagaggaggcggggttttagggaccaaaccgaggttgctcggttgggggcgctacactttgagggtgagggggcctggagcgactgagggtccggcgtttggccgggatcccggaaagcggcgtccctgggggtgtgggttttggaggggttcctgaggaactggattccgagcttgctcgcaaggcgagacgttccgtggaggcggagtttacgatgtatccaagtctgacggccccagaaacgggtgtgcagggcgcccattgggtccgcggtatgactgcagaaagagcctgggagatcgaggggcgcagagtggggccggaccaggggcgtttttagggatcccagtagttctcgtggtgctgcg

SEQ ID NO: 1212 - DNA, 500 bp, Homo sapiens
tgcttatagaggaggcggggttttagggaccaaaccgaggttgctcggttgggggcgctacactttgagggtgagggggcctggagcgactgagggtccggcgtttggccgggatcccggaaagcggcgtccctgggggtgtgggttttggaggggttcctgaggaactggattccgagcttgctcgcaaggcgagacgttccgtggaggcggagtttacgatgtatccaagtctgacggccccagaaacgggtgtgcagggcgcccattgggtccgcggtatgactgcagaaagagcctgggagatcgaggggcgcagagtggggccggaccaggggcgtttttagggatcccagtagttctcgtggtgctgcgcggcgatgatgatgactacggtgaggatggtacagagcaccatggccgcgatgcccacggccagggagatgaaggagaagttccgggcctcgcgtgaagcgatctcggccgacaccatgtctccg

SEQ ID NO: 1213 - DNA, 500 bp, Homo sapiens
gagctggggcggtgcttatagaggaggcggggttttagggaccaaaccgaggttgctcggttgggggcgctacactttgagggtgagggggcctggagcgactgagggtccggcgtttggccgggatcccggaaagcggcgtccctgggggtgtgggttttggaggggttcctgaggaactggattccgagcttgctcgcaaggcgagacgttccgtggaggcggagtttacgatgtatccaagtctgacggccccagaaacgggtgtgcagggcgcccattgggtccgcggtatgactgcagaaagagcctgggagatcgaggggcgcagagtggggccggaccaggggcgtttttagggatcccagtagttctcgtggtgctgcgcggcgatgatgatgactacggtgaggatggtacagagcaccatggccgcgatgcccacggccagggagatgaaggagaagttccgggcctcgcgtgaagcgatctcggccgac

SEQ ID NO: 1214 - DNA, 500 bp, Homo sapiens
ctgagggtccggcgtttggccgggatcccggaaagcggcgtccctgggggtgtgggttttggaggggttcctgaggaactggattccgagcttgctcgcaaggcgagacgttccgtggaggcggagtttacgatgtatccaagtctgacggccccagaaacgggtgtgcagggcgcccattgggtccgcggtatgactgcagaaagagcctgggagatcgaggggcgcagagtggggccggaccaggggcgtttttagggatcccagtagttctcgtggtgctgcgcggcgatgatgatgactacggtgaggatggtacagagcaccatggccgcgatgcccacggccagggagatgaaggagaagttccgggcctcgcgtgaagcgatctcggccgacaccatgtctccgcgggccaaggccgtgcgcacctacggaggaggggtgggggaaggaggtcaaagagctgcggcctcgttcgaacgcctcagcctttctct

SEQ ID NO: 1215 - DNA, 500 bp, Homo sapiens
agggcacagacacgaagctccgcggactcgttcatttcctccgttgacccacacacacctccccgccctcccctacacattcccaccgccccggctgggcgaaagccggagatgcccggccactccgtggaggcccgcgaggcgccagccgggcggcggcagggggttgaggcggatcttggaggatccagttctgggcctaggctgcgggatatggcagcgcagataaggtgggtgcagtgcggaagccgagacgccttacaggtcatagggtgcggcggacggccgcagagctgccgatcagcctgccaggcccctgccttcaggcgcattctcggatgccggcgcggtccagccggccttagcacagggcaccggcccgtgagcccgcggcgccagggggttaggctgcccagggctgctcctgactgcccagcggtgatgatccagcgcggggaagccaagactgccagaagggcggctatcatagtgcataacgg

SEQ ID NO: 1216 - DNA, 500 bp, Homo sapiens
accaaaccgaggttgctcggttgggggcgctacactttgagggtgagggggcctggagcgactgagggtccggcgtttggccgggatcccggaaagcggcgtccctgggggtgtgggttttggaggggttcctgaggaactggattccgagcttgctcgcaaggcgagacgttccgtggaggcggagtttacgatgtatccaagtctgacggccccagaaacgggtgtgcagggcgcccattgggtccgcggtatgactgcagaaagagcctgggagatcgaggggcgcagagtggggccggaccaggggcgtttttagggatcccagtagttctcgtggtgctgcgcggcgatgatgatgactacggtgaggatggtacagagcaccatggccgcgatgcccacggccagggagatgaaggagaagttccgggcctcgcgtgaagcgatctcggccgacaccatgtctccgcgggccaaggccgtgcgcacctacggag

SEQ ID NO: 1217 - DNA, 500 bp, Homo sapiens
aagcatgtctccctttctaggaaggttgtgcaggaccagcgttccctgtgcaggcgccactgcgtttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaaggtgggtcctgccgtgcggcgcttgccctgagtccccgtccccttctcccagttcttagtcactttcagcgcatcgtcgtcacgtggccatttgtgcagccggctctcgggggaggggtaaacaaccctggtttacaccgttgcccaaggggtgagtgggcgtgaggcacgtccatcagtaggcacgtgctgctttcgttctgcaagtgtcaaggcgagtgtcgaggatgaaagcatgaggcgcttgcagggggtccttggaaccaggtgccactcctcggcctgac

SEQ ID NO: 1218 - DNA, 500 bp, Homo sapiens
gaaaagagggagcgggcatggtcactgagtctccctgggaagtcccagaccaagaggtcacagccatgaggggaccacttttccagaccagtggggtacagattggggtgtacttcaggtaattgagtagcttcaacatctgagcttctcaagaaagccaggcctactgtcaaccaggagatgacagccaagacacctctgcagaagatgcaagcggcgaagccacggtgcggaccgttcgacagaaagcgttggaggcctcccagggacatgtcaggggacagggagcacgggagcgagtgattcatgccgcagagcctgccagtgctcatggggaggagaacgaatcaccctgctgggacaaatattatttttaaaagtctgggaaagaaaacaacaataaaacaagccgagctcaggatgactggtgagttttaagatgcagggaagggttgaaatgaatctgcgagttggaccatttgtttgaggccaaataaacc

SEQ ID NO: 1219 - DNA, 500 bp, Homo sapiens
tgtggagacagagaaagagaagcacaggatacatgaagcacagaggcaaaagggatccacagcctgggaaatcagggaaggcttcctggaggagatgccgctggagctgggtcttgaaggacgagtaggagttcgccaggtgaagaagggggggaagggcgttccagccagagggaacttggcccatctcctccctcctccccatgccaacaataatctgaggagcaggatgagctgggactgagacttcgggagccccgtcagcctcctcgtcacggctccgacatccaccaaagtcctggcagctgctgggctccagacggtgttcccacaagccggggaaggtttttaaaagataaaagaaacaaacagcagcaaccacaatacacagagtcagcatgtgtcacgcactggctccagacgaccccgccagagaaggagacaggtaatagcaggcgcacaggcggcagtccccaggggccagccctgctgctgaccct

SEQ ID NO: 1220 - DNA, 500 bp, Homo sapiens
atagctccaaccccagagaacggctgtgttgaggtgttttcgccccttcctcggtgctttgttcgaaaacatcctttgaacagtgtgcaaacaccaagcatggttttccactgggaaagccagctcaagaagcctgcgatgctggtagtggtcggcgcagagggtgtcctggttgctaagccgttcggaatgtttccacagctgcaggagtgcctggaattgtagagggtctttaaaagaaggaaacgccgctcgtcgctgaccgttctcattgagtcaggcgctgtctgaacctcccaaaacatgctgaaaggcaggtctttcatttgtttcagaccatttggccaactgtacgaagcgggtggggagaccaagagggttgcttccatactaggagatgaaggctctgactccacgaaagctgtaggcctggagggctctgaccagctctgagagctccagaaaagcaagcaagcgagagaaagagagagagaaaggaa

SEQ ID NO: 1221 - DNA, 500 bp, Homo sapiens
tttcctgcagattccgaccggcactgcaacggattccctgccggagctgaggtcaccaacaggccgtcgccatggagacccctggtacttctcattcccctgcgcctggggctcacggacatcaacgaggcctacgtggagacgctgaaggtgggtcctgccgtgcggcgcttgccctgagtccccgtccccttctcccagttcttagtcactttcagcgcatcgtcgtcacgtggccatttgtgcagccggctctcgggggaggggtaaacaaccctggtttacaccgttgcccaaggggtgagtgggcgtgaggcacgtccatcagtaggcacgtgctgctttcgttctgcaagtgtcaaggcgagtgtcgaggatgaaagcatgaggcgcttgcagggggtccttggaaccaggtgccactcctcggcctgacggggagccccgccccctcccgggtctccactgtgccccaggcatgcccaccccactcccccaca

SEQ ID NO: 1222 - DNA, 500 bp, Homo sapiens
ccccaggtggaaggcgttgtcggcagactcatctactgtgggaggcggggagcgaggcaatgaggccgaagactctgagtcagtgtagcctgagcgctcgctgaccccagcgtgcagttggaggatagtactctcactgaggtcactgtctgagtcagagctccagccctcgatctctcggcgtaccagtgagtcaaagaaggccatcatccgggggtcttcctggaccgactggttggcgtagtcatgcgacaggccactcccactgttcagcacaaggctgatgtactcttcatgggtatagaggcagcgggaatcgtcctcaatccgaccgtcgaggtctccagtacatcctggctgcttgtatgggctccagatctgaacagaaaatgaaaaacaaaagcaacaaggagtaactggaaagtattctttcactggtggtgataaagaacaccaaggcagaacttccccagactctccctgtaatttaactaggactt

SEQ ID NO: 1223 - DNA, 500 bp, Homo sapiens
catttccgcactgctgaatagctacttaaggcctttcaggagtttctggatttcaaatagactcccagggtgatcccagaacacggcagggagggggaagggagctcaactccacacacaatgggaaaaattgtcggcgacgcagcccttcaggagacgggacttctgaatgagcgagattgcagagccagcgcttcccctctgaatcaccgcagatgtgcagcgtggtgcggggaagcaagcgccaggcgcctggttggggggcctgttctaaaaacattctgtgaggttgaaagcccagcctggcgctaagcactgggaacccgagaggcctcctgtgggccgacgccagaggcagggccaactccaggctgcccaagaggcctctccctgtccgccccttcgggtggctgatggttcctttcaattctgcttttgaaacctcccttttccctgcatggtccccacagccactgcctcagtccctgtgctcgttgcct

SEQ ID NO: 1224 - DNA, 500 bp, Homo sapiens
agagaaagagaagcacaggatacatgaagcacagaggcaaaagggatccacagcctgggaaatcagggaaggcttcctggaggagatgccgctggagctgggtcttgaaggacgagtaggagttcgccaggtgaagaagggggggaagggcgttccagccagagggaacttggcccatctcctccctcctccccatgccaacaataatctgaggagcaggatgagctgggactgagacttcgggagccccgtcagcctcctcgtcacggctccgacatccaccaaagtcctggcagctgctgggctccagacggtgttcccacaagccggggaaggtttttaaaagataaaagaaacaaacagcagcaaccacaatacacagagtcagcatgtgtcacgcactggctccagacgaccccgccagagaaggagacaggtaatagcaggcgcacaggcggcagtccccaggggccagccctgctgctgaccctgtgtgaccc

SEQ ID NO: 1225 - DNA, 500 bp, Homo sapiens
gcttgccaaactgctcgtgggatcctcctactcggacccgttctctttggtgactcggcagcctgttccatgtggcaggcaggatcctggctgggctccatgctccctgaggcgggtgggctggccagcccctgcccagtggccccggagggcatttgggccacaggaggggcagagtgttgaagtcaggacaacactgggttgggggggggttcggttctaacttgaacttcatcggggtggcgtgttcgcgtcacgtggccgtgtttgtgtgagcagggctgccctgcacctcctcaacatgctgagaagtggccggggctgggatgcgggccgcggcttcaccgtgcaactgcggcccattgctacgtgcctcgtgtgctctgccatggagcccaaatgtggcaaagtacggccctttgaaccctcaaagcaacatgcagcaattttaagtgcgaagggagaaggtttttcatattgatggggtttttcctccttca

SEQ ID NO: 1226 - DNA, 500 bp, Homo sapiens
gctgttgtgtttccgcgttcccttcaggacccaaatgccagtgcggtggtagaagcaatgcctacatgttggcgccgaaactaatgccacaacttttctttgcatagttcccaagaaaaggatttctaacagtacaggaatgtatttcttcatttccttctagtgtcttagcagtatttcatcaaaacagatatcagtatttaaaagaaaaataccagaaaggactgtcataggaagacagatggattacgcacagatatttaaagtgggtgactcaagcccaaagaaaaccttaattcaacttgcagatgtaacagaatgaaatagagttcggtgaggtctcagcccaagtctttctatattgcatttcccagcactgtttctcctccttcttttactcaggctcagggcatctctggttctttacattttcccattgctatttgcttctttggtgatgagttcctggagtgttcctcgactttcctgggcagtcagag

SEQ ID NO: 1227 - DNA, 500 bp, Homo sapiens
atttctaccctaaggccacagagatcttttaaaaatcccaattattaaatggaagctcagacttttttgttaaagttcacatcaagtgcgcatgtctggcctgtcaacatctgtcccctgttgggccctctggcctcagctccccctgcagctgcactcagtctttggtcatccctctggccatttccagacgtctgcctccaggccttctcagtgttgttgcctctggctccagcgaaccacatttttcgtcagagcgtggttggttcagttgaccctataggattgactcctgtaggaagcctacccagagtgtcagtctaattgaaacatcttgttctgtctgtgctaccctttccagcggtacttaggctgtgagtaattgactcatgaactgctttccttattagatagtgatttccctgagagcaggattactcactcaactttgtgtccctgagactagtgtgcctgatgctatcctaaaagacttatattaa

SEQ ID NO: 1228 - DNA, 500 bp, Homo sapiens
tcaatagctccaaccccagagaacggctgtgttgaggtgttttcgccccttcctcggtgctttgttcgaaaacatcctttgaacagtgtgcaaacaccaagcatggttttccactgggaaagccagctcaagaagcctgcgatgctggtagtggtcggcgcagagggtgtcctggttgctaagccgttcggaatgtttccacagctgcaggagtgcctggaattgtagagggtctttaaaagaaggaaacgccgctcgtcgctgaccgttctcattgagtcaggcgctgtctgaacctcccaaaacatgctgaaaggcaggtctttcatttgtttcagaccatttggccaactgtacgaagcgggtggggagaccaagagggttgcttccatactaggagatgaaggctctgactccacgaaagctgtaggcctggagggctctgaccagctctgagagctccagaaaagcaagcaagcgagagaaagagagagagaaag

SEQ ID NO: 1229 - DNA, 500 bp, Homo sapiens
agagcggagggtgtgccagaggacacacacggagcagtgagtctctctgcaccacactaccctgccactctggagcgcccatgactcaagtaaaaggcagccagaacctctgtctgccctgagacacaaaaagggggatttatcagattcaggaagtacaaccaggacactgggtatgagtgaggcattggcattctgcaccctgaggagcacgcactcacactcacagcagagctgctacagccacgccggcgtatgcagggaggtgcgacccctcgactacactcccaggaccaaggggccctggggaagtgagagttggaagcaaatcccccagtgacacaaagggccaggagtgctggtgtggttagcaggcatgagcccggcaagttcccatgacaaccctgggatgttcatttacagccaatgaatggctgctgtggaaggtctgggagctctctagtccagctggagggcacatgggctctgcagccagatgg

SEQ ID NO: 1230 - DNA, 500 bp, Homo sapiens
tagcccccaagtgactgcagtggtgggtccacaggcagcctgcagagcccgccctgcagcatgccagctgggcctgtgatggggcatccagagggtgttgccctgaacactcagcatgtctccgctgacacagtgtgctcaggctttgttaacatggggcctgttggctgcagagactcaggagttgagagtctaatttttggacctgctgatggttaagtcatagtgagtcagtgttaacgcgcaaagcgtttgacgagtccaatgtgcttccatactaagcagcaccaggtttcttttgctaaaattgaactcctgtgaaaaattcagagtgactaagttcattcaacaaagaccgtgggagcccgaggctggtaaacaatgagtccatcccgcatcccaggggactctggtggcagtgcagttttgccgagaggagttttaatttaaaaaaatgcaatcaggagaccagcaggtcctggaatgagtcaccctcagtg

SEQ ID NO: 1231 - DNA, 500 bp, Homo sapiens
acctttgtctctcatgggtctggtgctctaagtctgaggagagatctgctcggggcctcttttctcagataggagcttgattaggtgtcctgactgctgaaagccacttagagctttgttttgttacaaaacctactgaatcttggtttcctcatctaataaatggggataatgataagtaccttgcagggttgtgaaagtaaagtaaaatagtgtatacaatgcaaaagcagactggttcttactcaccggtgactcagggaacgcagctgtgacggaggccttcctgaaggagggtgctcctgcggctctgcctggctcagggatgggatgggaggtggcctggcacaggggaaaggacaggctttggacgtggaagagtgcagattcacatcctggctttgtccccagcaagctataggtgtgggcaattggcatctcactaaggtcaccatcaatgcatcatttctgaaatggagatgattctgcccccgcagtga

SEQ ID NO: 1232 - DNA, 500 bp, Homo sapiens
ggagaacgaatcaccctgctgggacaaatattatttttaaaagtctgggaaagaaaacaacaataaaacaagccgagctcaggatgactggtgagttttaagatgcagggaagggttgaaatgaatctgcgagttggaccatttgtttgaggccaaataaaccaacaaagaactcgattcaattacaaaagtttagaattggatggtgagtcagaagctgagagcccaagaggtctaatcgggtctgtgcgtggcctggagtccaggaccgagaggaatggactctggaaggctggttcctggtggtgataggaaaaggcagaacatgtgagtcagagcacgcaaatgtgacagcccaagtcgggacagcccttggacatcttggtgtatgtaggtgggagtctcttttcttaataagaaacccagttaggaccagataggatttggggtgtagcaaaaccaaggagcctgaggcagaagtgaagagaaagacgagaaaa

SEQ ID NO: 1233 - DNA, 500 bp, Homo sapiens
aaacatatttcaagagcaacaggaaaaaaggtacatcaagccatttgaaaacaaaaatttattgcttctccttccaaagctttgtgaatttacaaaaaaaaggatgaaagtttacaaactgcttagttccaactaagcataagaggtgagaacgtacactgcagggccaccagcagcagctgtgcactgatgttaaaactggctcccccagacttgtagtgctgtcttcagggggctgcattccttacacgccacctcttgtgacataggtcattggtcaagccgctggaatgctacagaggtttttttggttttgagaggcttttttttgttttgccttcctactataaaagcgaaattttcagttcatttctgaaaaataaattggtcaataaattcattttgttctgcttctactttacacaaagcttcatattcaacccgatacctgaaaaacaaaattgttagaggccctgaaaaaaagatgaagtaaaccacag

SEQ ID NO: 1234 - DNA, 500 bp, Homo sapiens
tgaaatagttggagacatctaattactttctcctgagatggtttgcctttttcttagaacaggattttgagactataaagagatctatctctctgctcttgatagttagaattattgcgtctccttgataagatattgagtatccttcttatgggtctgagtttttttagcttctctaccattggaaataacaataatgcttgccacgaaaccatctaaaaatccatcgtctttgcagtagccttcaaccggaactactgatagctgttcctgcagtgccgttgttctcattggagcatactacagaaacctatttatgaaaatatcttgtggtttccaaatagttgtaggaaagggaatttttggtcacttatgcaatttacagaattgaggtcagttgaggatgttgggatagttctgactggagctgtgaagacaaaggtatgagtaatactctagatctctaagctcatttccaattgtatattgtttgtgagtca

SEQ ID NO: 1235 - DNA, 500 bp, Homo sapiens
aggggaatcagaccaggccctcgcatgcccgcccaggctgacattccaggatgtgatgactagaactatgtaaaatgtgatatacacatcaacaagggtgattcagattaccaccaacatttcttaacaaacctagctaaaaaacgttagaatgtgcttagccttcccattctcttttaactttttatctaaacctacaaattctgaagcttctgtgggaagctatgcctcctccgagatgttgttcttcgtacgttttcaaccatacagcggcagcgactggagtggttgttttgcatgtcaggcttcactgggcaatttcttcagaattcagagatctacctactggaactagcatctgtagacagtccagtaactaagagtggtagttctgagttaggtgggcctgagacctggcacactcttaacctccccaatctaagacatatcttatggaagtccccttctcaaaccctgataaagattgaagggccaagcgt

SEQ ID NO: 1236 - DNA, 500 bp, Homo sapiens
tctaccaggaaagcttcttactcttggctctgagccaatttcctcctcagaagttgctgcctctccctgaggccccacgctgccatgagtccttctgactctctgtgagtcaccccactgccatgactccttcggagggggtgtctgacctcttgcttcaggcctcttctgggcctcacagtaacccttgtgaagctgaagatgggagctctcatcttccctaacccagagccaaccttggcctctctgcgtcatttgctgccagtgccctgtgtttgtttttgggaagagagggattttcaggcatcccgtccctcacccacctgacctaaccgtatggattcctgacaccacaggcagaggactattcttcaggttcctctgaagcccacctgttcagatgcttgcttcttttccttcttgcctgttctgactgtgatgacagagaccccgcctcaggaatctccacctcacactctattctcataagtaggtagaat

SEQ ID NO: 1237 - DNA, 500 bp, Homo sapiens
catcctccctgctctccgattgccccagtgtgtgtgtccccttccccagccacccctctgatccctgactaccctcttctccctccctccctctgcgcccactcctcatcgcgggcctcaggggagccctgtctccactcaagacacccgtgaaacagagggagacactagcagtcagcgggcactttgtggggagggccaatttagaggacagattgaccagggcgagcagcaggatatctagaaagacgctttgcttctaaggagcgggagcctaatcccgttacaggctggagggagactcctggggccggcaagcctccttcccgctgtgcctggagggatatcattggaggaccgccgggcgcggtggagggctccactcgccagcagccccctcccccagccccttccactctcttttcttttgcagtgacacatactgcagtgcctctgaggtcatttgtttcccacagcctcacagggcgctgtggcaacaa

SEQ ID NO: 1238 - DNA, 500 bp, Homo sapiens
gcatcaccagccaggcagaacgtgagttctgccagtaatcctgaaaatgactcaagtcatgtccggattactatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggc

SEQ ID NO: 1239 - DNA, 500 bp, Homo sapiens
agcatctcattgccttattcatacctgctttgaaagatatccttgtcttactcagttggaagctctataagccccccattaaggccaaagaatgtgaaacatcacaaacagcacagcatcatgtacataaactgtttatttaagagcgggcagtcatagactgtgggtgatccgggagatgcatcagtagatttcctgtggcctcagaaaaatccacgcagtaaccgcaacagagagatgacaaagagtcggttgcaggaggcctctgcccagggagggtggccacctaccctgtgcagttcaggcagagcacaaaggctcctcccagggccctggggaaggctgaatccagcctgcccctggcttacctagcttggccccgggcagagcacttttcctccacccctcacagaggcgcaggttacttgtaccagcccgatgcaaatgctttggtgaatgggctaccctaaaacagaggatgatgaagaacgatggccatt

SEQ ID NO: 1240 - DNA, 500 bp, Homo sapiens
cccaagacaccagtcccatcaagtgactcactgaccaagcctaagaggagcagaaagtccagccacgctgcctgctgggcctcgcttgcctgaggagccatttgcttgtgtgcagcgcattttaaaagcatgccaggaaattgaaagtcacgcaaaacaaggaataggataggaagctggtcagccagggtgtaccctggacacagctgggaacctggcaccacagctctgccctggctgttctcacaccgaggagcaggcacacaggaaaagatttttgtaaaccgatgaatttgttttccttaaattttctacaaggctgatcgaaccagcagcataatgttattggatacaggaatctgggtatcattttacatctcatacaaagggaaaagaaaccttagtagaaatatattaaaactttggtgtttaatctttaaagtgatcaataaggtgctcaaaggtgaacctccaccattagtcaattgtcttgaatcagt

SEQ ID NO: 1241 - DNA, 500 bp, Homo sapiens
ccagctctgcagcagggaggacgtggctgggctcgtgaagcatgtgggggtgagcccaggggccccaaggcagggcacctggccttcagcctgcctcagccctgcctgtctcccagatcactgtccttctgccatggccctgtggatgcgcctcctgcccctgctggcgctgctggccctctggggacctgacccagccgcagcctttgtgaaccaacacctgtgcggctcacacctggtggaagctctctacctagtgtgcggggaacgaggcttcttctacacacccaagacccgccgggaggcagaggacctgcagggtgagccaactgcccattgctgcccctggccgcccccagccaccccctgctcctggcgctcccacccagcatgggcagaagggggcaggaggctgccacccagcagggggtcaggtgcacttttttaaaaagaagttctcttggtcacgtcctaaaagtgaccagctccctgtggcccag

SEQ ID NO: 1242 - DNA, 500 bp, Homo sapiens
cctcagctgtgggacccctggggaggcacatcttccctcagaaaaatggggaactcaggagaacagggacattgtaggagctgcttgactgcattgtcacaaggattcatgagctaagaatgcaaacagagccctccccatggctcctggcaggccgtgcagttatcgtcttttattatgcaccagatgggaaccgtaatacctgccgctcctcttccgagggcgatagtaagaatcaaaagataatgcgcgtagcattgctcgctgtgccgtactgagatgctggaagcgctctaattacgcccggtacaacgctcagctcaggctctgcagcaaacctggccagaaacagaccctctgcctctctcttgccggcccctagcaccatattgaattgatcactggaaactagagagaacgctgtctggtggataatggcctgaagagaaggctttgtcaaaataaccaggccctgaaatgcctccaggtctctttcaaga

SEQ ID NO: 1243 - DNA, 500 bp, Homo sapiens
cttcaccggtttctgctccaaatcactgagtgctgttcatggtcacttctgattaggtacttaacacactggcaccagggacaagcagtttctctttaaggcacccgggtcctggctcgtcccctggtgactgtaagccttgcagctcactgggcatcacacggctctgtgtgtgcactggttgcatggcagcgtttgactgatggagaactcatcagaagcatttgttctgcggacggtggcacatactgtgggcctccattaaagaggggtagcgcccccctcacctgttttctgggggctgatatcttgcggtagcgagatgggcatctgtcacccatggccctggtcgtccccttgctgaccctctgcatccctcttccgcaggtggctgccataacagccttaaggtgaccagcagccccgccattgccatcgccaccgccgccgccgctgccatggtctccgtggaccctgagaacctccggggcccgtccccc

SEQ ID NO: 1244 - DNA, 500 bp, Homo sapiens
aacaaaaacaaaacacgaagcaaataaacattagtaaacacgtcaggataagcggcgatataggctgggatagaaaggtgtaggtgatgtgagaggcgagtgtccgtgcggacagaggagctgggggaggagactctgaggccagaggtgtgagcggagtgagtcgggcacgctttccagacacaaaatcggtgtttgctaaacatgcgtggaacaaatgagtggctaacaagccagaaatcccaagcgcgtgccccgtgtcgctccagacacaacttccccaccctcatcaccctgtgggtcactccgactggcacccagacgcgtttcccagcccacacgcctgctacagggcccacctgtgtcaccctcgcagaggcgcttaccaggactcaaggggctctccgctcagaacccctcatggcctccctgacaccaccagcggccctcgggctggacagcaagcgggttttgtctcgcctgcagactccagccccgga

SEQ ID NO: 1245 - DNA, 500 bp, Homo sapiens; identical to SEQ ID NO: 869

SEQ ID NO: 1246 - DNA, 500 bp, Homo sapiens; identical to SEQ ID NO: 884

SEQ ID NO: 1247 - DNA, 500 bp, Homo sapiens; identical to SEQ ID NO: 866

SEQ ID NO: 1248 - DNA, 500 bp, Homo sapiens
aatcctgttaggaaaaatgaagtctactttaggaggtgagagaaggacaggaaaaaaaaacaaaggaagcttggatgtcaacagtcctctctgccgcccacgtcctctctgtctctgcagctgtgtgcctccatggcagtgaccagcaaaagcgcaagggtgccgcagccacggcgaaaagaaagtccaagggtggaggggtgaacgtggagggacgtctgtgcacctggccccctgaagacccacgtgcgtctgggggcacattgcgggggaaggaacgtgatcttcacacagaaagggacagttttaaccgttttctgttttcatgttctcatttaactgttggccggaaattgccggtaggctgccgtggcctgaccctactacgtgcacaactccgcaggcattaggggaggggtcatctgctctaattaggtaacaggggcaagtgggattaaagttttaaggcagttatattaagaagctgaggacaggattcc

SEQ ID NO: 1249 - DNA, 500 bp, Homo sapiens
ggcctagggatcctgtgccctgggacccatgaccaagccagggggtggagggattgggggttgcctgaaattgtccttattttattcaggctggggtggggtggagtcccaggcacagggaccttgttttgagaagtggctgtgcctgggactccgcccaaggattggggggatgctgtgcccagggtgcctctgagacctgggggcaggctgtgcttggagtccccctaggccttggcgtggtgggaacgctgtacccagtgaccccatcctcgagaccgtacctaggcagttgttgtgctgagacccccttaggcagggagaggtagggattgtgtctggaatcgcgtcctggaggccttggtttgatacgggggctgtgtccccgaccccatctccatccccatctagttctaggagttgtacctagaatctctgtacccctgtccttggttttgtggggggtctgtgtccaggatccctatttccagggccttggc

SEQ ID NO: 1250 - DNA, 500 bp, Homo sapiens
acattccctcagaaaggaaaaaaaagaaggaaaatgatacctaggaaaacatgcaagcctgtttcatttatttgtatcctaagcagcagtgtcatagaacagacagtttgtttcagccaaccagactggagcagctgcgagtgctacatcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttccaggaaaaagaaggaatcccggctgcagcctcctgccttcctttatattttaaaatagagagataagattgcgtgcatgtgtgcatatctatagtatatattttgtacactttgttacacagacacacaaatgcacc

SEQ ID NO: 1251 - DNA, 500 bp, Homo sapiens
ggctccgtgtttctaagaaccacagcccagcatcattaaagaaggcattattttgtgtttagtagagcactaaattggtgaaatatagttgtgattctggtagtgaatatccctgttgccacggtaacgatattatgtcatgggaggctgtctcgagtgctcctgggagcagccaggtctccgtgagctcctgtttactctaaagactccggcagcccacatgtgtgcacgctgaataaaatcgtgctgcgggaccacagtgcggggaggcaccgactctgtcattctgtcaacgcaccgcacagtcacgaacatcagcattgacatgaaatggacggttagggagctgcaaaggactcatgctcctctattgcacgaatttgtcttttcatattcaaagtacttgtaagagctccaagttccacgtactcagccactaacctcaggcatctgcacgggagacttggtacacaggctcacatgcatgcacgcacacaggc

SEQ ID NO: 1252 - DNA, 500 bp, Homo sapiens
gcaggacggcatccgcagcaagcccgccgccgatgtcaacgtgcccacgtgctcgctgtgtgggaagactttctcttgcatgtacaccctcaagcgccacgagaggactcactcgggggagaagccctacacatgcacccagtgcggcaagagcttccagtactcgcacaacctgagccgccatgccgtggtgcacacccgcgagaagccgcacgcctgcaagtggtgcgagcgcaggttcacgcagtccggggacctgtacagacacattcgcaagttccactgtgagttggtgaactccttgtcggtcaaaagcgaagcactgagcttgcctactgtcagagactggaccttagaagatagctctcaagaactttggaaataattttatatatatataaataatatatatatatatacatatatataaatagatctctatatagttgtggtacggtctaaaagcagtcttgtttcctggaaataaaaagttgggatat

SEQ ID NO: 1253 - DNA, 500 bp, Homo sapiens; identical to SEQ ID NO: 1249

SEQ ID NO: 1254 - DNA, 500 bp, Homo sapiens; identical to SEQ ID NO: 1250

SEQ ID NO: 1255 - DNA, 500 bp, Homo sapiens; identical to SEQ ID NO: 1251

SEQ ID NO: 1256 - DNA, 500 bp, Homo sapiens; identical to SEQ ID NO: 1252

SEQ ID NO: 1257 - DNA, 500 bp, Homo sapiens
ggggcactgcacctcggcccctctgctcatcttgggcaggtgacccaggtggagctcaggcccgaggtctgtgctgggccgtgggtccccttttgaccgcccccccggctccggaccccaagcccctcctcgctgactgttcctcggtcccacccgcaggccccccaaagatggcggacaaggtggtcccacggcaggtggcccggctgggccgcactgtgcggctgcagtgcccagtggagggggacccgccgccgctgaccatgtggaccaaggatggccgcaccatccacagcggctggagccgcttccgcgtgctgccgcaggggctgaaggtgaagcaggtggagcgggaggatgccggcgtgtacgtgtgcaaggccaccaacggcttcggcagcctgagcgtcaactacaccctcgtcgtgctgggttagtcgctgctgcggtcagaggtcatgggctgggttggagccaggcaggggtgtgcaggagggcgg

SEQ ID NO: 1258 - DNA, 500 bp, Homo sapiens
tccattagcgatcgctttaatgacaatacccccgagttggggtttaaactaaagaaatccagttcatttccagcttcaatctgatactgtaccaactgaagttcatctgcatcaatagcagaaacagtggttatttgctctcccacgcctagatctctgggaattgtcccttcacaatttattttctcaaacaaaggtgtgttgtcattcaagttattgagagtaattgtagcaaggacttcgacttcccggcggtacggcaagccccagtctgatgcacgaatcctcagagtataaacccgaggcatcagttcgtagtccaggttttctgacgtactcacggcaccagtgaaatggtcaatcgcaaacggcacatgatttaaatttgcgatactgtatgtcacgtacccgttctcaccctcatcagggtctacggcactcaggctcatgacagtagtaccaatgggcacgttctcatcaaaagcagctttgtacgctgt

SEQ ID NO: 1259 - DNA, 500 bp, Homo sapiens; identical to SEQ ID NO: 339

SEQ ID NO: 1260 - DNA, 500 bp, Homo sapiens
cccagagccctttcttgttggaaaaggagacttgtgccgggatgtggccagccacggccgcgcctgggtccccttccccagcccctgctcctgtggttggttcccccggatggacagagctgggcccccaacagagaacgatgcttgaggatcccattccaagccaatgccgtctctgcctccctcccggctcggagcacaaggcctgcacgctgagggcgagtgcgtggtggagcaggagcttcggggcggtgtttctcacccagccatgtctcccctgcccagaaccgggcatcaaggggagtgaactgcgggctgttttgaatttgagggacaagcttggttgtcccttgttccctgcctccccattccaagcctcctgtggcagaaggaggccaggccatatcttgagggaggattctgggcgtgcctgcttcaccccaacagcccaaggtcaggggaggggctccaggccgcagggggtacagcaaggggaagcc

SEQ ID NO: 1261 - DNA, 500 bp, Homo sapiens
gacgactctgaatgagcaccagccgcgaccccaccacggcctgaaaccagtttccgctaaaagaaatcagggcttcttggagaaaaagcgaatacaggtctggggtagaaggtgactggacgagcccagggcagcctgccgtgcagacaggaagggagcggtcaccaacaccagagtacaccaacagcactccatgagttcacggggacatgaacaataaactgaccctcggtcgaaggaagcagggaacgcactcgcccccgaggtcatccggcctttctgagcagcctgcacctctggcacccaacaccaggagacagaaagacttccttctgggatcatcccagctcacaaacagaaagggcaggacaggctctcatcagttggcagccctgagcaaggctggaggtctcgacactgctggtgtccctaggtgccgcatgcggcaggctcctgagccaagacgcagcagacaccgctactgtcacccaagaggcaaa

SEQ ID NO: 1262 - DNA, 500 bp, Homo sapiens
ccatcggagccagggaaggaagctgtactttctgggattcctaagcaggcctctggccgggcccaccagtgaaaaacaggagacctagattccaaatcagtgggaggtttatactacgtgggcctagcgtgtgttggggggaagatggtgcaaagagctctgaacaacagctgcagctgagaaccgtgcagcctctcccatctgcggctccggctgcctcggagccatggaatggtttcaacaactcctcgacaaggccaagttggtatttatgtctcatcaaacccactctacaaaggaaatgaaaaagcaactgggagctcctccaggatgtgggagggagggagctaattactgggcaaggagaggcgaggctaacaggggccacgctgaaagcaccctgtccctgcagcgaggggatgggagccaggggagtcagaagctacccgtcccctccactggccaaaaacccaacagctcttggcgcatcgatcctaagc

SEQ ID NO: 1263 - DNA, 500 bp, Homo sapiens
ccagacaaaacacggaaaaggaaaagagaatgtattctattaacccatttagccagccaacgggaggggagggaagacaccctcgggtcctgcagatgagcctgagtgtcaaagtcagatactttggggggtggaatccattagatggcaaaaacgaagtgatatctcacgcatgttcccctttgaataatagctagaccaagcaaggctggccgatgggagggaggagtctggacgttggtaagtacacgcacattgggaaaagctgttggcaacaaaaactcgcagcggtatttggaaaagttggggagttgaagaaaaggagagtcgttttcctcacattttaaggggtaatgattccggaaatggatgataaaaccacaacgttgattagaaatttggatggaaactgcaggcagacctcccaagtgagcccatctcattttccctccaccaaaagcatccaaaagctacaaacactacctaatggccctgccaag

SEQ ID NO: 1264 - DNA, 500 bp, Homo sapiens
gggtatgcttccttcctggccttccttgtggagcatgtctgggagtgtgctaggaaatgagggaggaaaatatgtaacttgatatctgctccttgaccctggctgacctggttaactctctccaggatggaagcaaagcctgcccgggaaaccttccattgcaggaacatctcggcctgaagctgtcatcagggagcaggatctgcttcccggactctgagcagaacaatgggagccccagcaggctggcgaggctgacaagccctaggacggtgacctctccgatctccagatcggaaactcagaaacgtgtaagtgccagaatccgcatttgggaatctgttatttctccctctgcgagtcaacctgatcaccctggaagcctcactgtctctcagcccttgttcccatttttctttccatgaacaccgcaatcagatacgagattccagtaatgatggttcttgaaaattaaacaaatcaaaaagaaagccagccaa

SEQ ID NO: 1265 - DNA, 500 bp, Homo sapiens
agtgcagtggcgccatcttggctcactgcaagctccgccccccgggttcatgccattctcctgcctcagcctcccaagtagctgggactgcaggtgcctaccaccaagcccagctaattttttgtattttttttttagtagagacggggtttcaccatgttagccaggatggtctcgatctcctgacctcgtgatctgcccgccttagcctcccaaagtgctgggattacaggcatgagcctccgcccccggccttaaataattcttaaaggaagtaaagttaactttgaaagaactatcaggatttggattgactgaaaggagtggggaagcttagggaggaggtgcttgccagacactgggtcatggcagtggtcggtgaagctgcagttgcctagggcagggatggagagagagtctgggcatgaggagagggtctcgggatgtttggctggactagattttacagaaagccttatccaggcttttaaaattactct

SEQ ID NO: 1266 - DNA, 500 bp, Homo sapiens
agtcagctgtgaaggccaagatagggtgataggcctgtgggtgggctgggatggggcatgggggcagaggccgccatggaggagaagaggtattggcctcaacgactccacctccccgccacgtgcccagatccgggatggaaggaccctataaatgcccacaacccagcctccccagaggccttgagaaagagagcgatagagtgcgagagcgagtgcccggagcatcctggccctgagacagctgggccagccccgcagggctctgcagcatgtgggagctccgctccatagccttctccagggctgtgttcgcagagttcctggccacactcctcttcgtcttctttggcctcggctctgccctcaactggccacaggccctgccctctgtgctacagattgccatggcgtttggcttgggtattggcaccctggtacaggctctgggccacataagcggggcccacatcaaccctgccgtgactgtggcctgcctg

SEQ ID NO: 1267 - DNA, 500 bp, Homo sapiens
ctttttaatttctgcttttatgacttgctagatttctacctaccacacacactcttaaatggataattctgccctaaggataagtgattaccatttggttcagaactagaactaatgaattttaaaaattatttctgtatgtccattttgaattttcttatgagaaatagtatttgcctagtgttttcatataaaatatcgcatgataataccattttgattggcgattttctttttagggcagtagctcgcctgagccagagatttcccaaagctgagtttgcagaagtttccaagttagtgacagatcttaccaaagtccacacggaatgctgccatggagatctgcttgaatgtgctgatgacagggtaaagagtcgtcgatatgctttttggtagcttgcatgctcaagttggtagaatggatgcgtttggtatcattggtgatagctgacagtgggttgagattgtcttctgtgctttcgtctgtcctatcttca

SEQ ID NO: 1268 - DNA, 500 bp, Homo sapiens
cagggcaggttttctgcagagcacggaagattcagctgaagtcagagaggtgaagccagtttcccagggtaacatagtgaggcactgaaagaaaggagactgcactggagcccaggtccccgggctccccagagctccttactcttcctcctcctcagcagcctggagaccccacaacctccagccggaggcctgaagcatgaggccatgccaggtgccaggtgatgctgggaattttcccgggagcttcgggtcttcccagcactctggtctcgcccgccctgcctctcgggctctgcccagcttcctgagtcctgacagagcacagtgggggagatgttggcagaggtggcagatgggctcacggccatccctcctgcaggagcagcgactggacccagagccatgtggctgtgccctctggccctcaacctcatcttgatggcagcctctggtgctgtgtgcgaagtgaaggacgtttgtgttggaagccctggtat

SEQ ID NO: 1269 - DNA, 500 bp, Homo sapiens
ctccccagatgccttgtaggcctgtgacactggtgttgagggagacattgtccatccctggaaccctctgctcaacagggggacagtcagagacttgagcatccaacccccacttcctgccagctctgtgctcagggacccacagagtcaagcaagttattgaattcagcataccgaattttatttattgccgctcaggagggtgggggcctgctgaaagacagggtcggggcctgcctcctgcatccccggcccaaaagcccgggccaagaaggacacaggcttcaatggctgtcatgtgttgcagacaacatggtgttgagatcttgcatggtggagggtgacgctggtccctgaagggagatggaggaggaggcagagctgggaacaaagggttaaagggcgccatgtaagagagctctccattcccaccacggagacatccagaccccagcagaggcccaaactgactcacaaacacacagccccatctttcccct

SEQ ID NO: 1270 - DNA, 500 bp, Homo sapiens
gcagggcgggcggccaggatcatgtccaccaccacatgccaagtggtggcgttcctcctgtccatcctggggctggccggctgcatcgcggccaccgggatggacatgtggagcacccaggacctgtacgacaaccccgtcacctccgtgttccagtacgaagggctctggaggagctgcgtgaggcagagttcaggcttcaccgaatgcaggccctatttcaccatcctgggacttccaggtaggcaccgtgcaccccggggtagagccaggtgaaccaggtgagcagggaagggggcgtttgcgttaagccccactcccacctctgggtgaggaccctggcagctctggctcagaatgaaaggtgtgaataaaaggagaagctggctcgtgtctaatagggcaacagtcatgcaggagaaaatgggagggttaatactcaaggcgaaggaatcgctagtgaggaggcaggcctcaagaagaatgggtctattgtaagg

SEQ ID NO: 1271 - DNA, 500 bp, Homo sapiens
ccgtgcccatggagaggctggcctgctaggctgtggggcccgatggcctgacactgtatggaccacgctcctgccctgccctgccccgccctgcccgtggcccgtgtgcagaagtgggcaggcctgggttgctgggccagagccccgagatttccccctgccccactggctgagtgtgggggagctgcttctccacttccgcgtgggtcttggccctgggaggccagtggccgaggctggtctcgcgggcgctcgctccaggagtggcgcgtcccctcagcgccctgtgcttcctcgcagggatcgactacaagaccaccaccatcctgctggacggccggcgcgtgaagctggagctctggtgagttggggctgcggcacttcagttcctgggtgaggacacaaatgccgaagggagaacagaacccttagagaaacaggaaggcgtcctgtttgcatttcacttggaagagccacttacacagcccctgtttaaacat

SEQ ID NO: 1272 - DNA, 500 bp, Homo sapiens
tacgacttcgtggggaagctggagactctggacgaggacgccgcgcagctgctgcagctactccaggtggaccggcagctccgcttccccccgagctaccggaacaggaccgccagcagctgggaggaggactggttcgccaagatccccctggcctggaggcagcagctgtataaactctacgaggccgactttgttctcttcggctaccccaagcccgaaaacctcctccgagactgaaagctttcgcgttgctttttctcgcgtgcctggaacctgacgcacgcgcactccagtttttttatgacctacgattttgcaatctgggcttcttgttcactccactgcctctatccattgagtactgtatcgatattgttttttaagattaatatatttcaggtatttaatacgaaatgtggaagggaatgctggagtaaaatatcccctctcccctccgcccgcccacccgcccgcccgctcgcccgctcgcccgctcc

SEQ ID NO: 1273 - DNA, 650 bp, Homo sapiens
ctacggacacatataagaccctggtcacacctgggagaggaggagaggagagcatagcacctgcagcaagatggatgtgggcagcaaagaggtcctgatggagagcccgccggtgagtgtggttgcgtgtgtgtatgtatgtgtgcgcgcgcacatgtgtgtgatgggccctgcctcctctatcctccctggcctgtttccttatccagatccattcactcaactaacctaggactgtgataagtcaggatggggacaccaagaccactaagccagggacccttggggagctgtttgtgggccaagagccactataggggtccgtagaaagggctgtccgtagacagccctgagtcagaagccatgagaaacttcagaagtcaggggacacttctcagagaaaaaccacatacgagctggagccagaataaggaggagctcgcccggtggagaaggaggaaggcattccaggaaggagggagactctgtatcaccgcatggcacatgtgtgtgatgggccctgcctcctctatcctccctggcctgtttccttatccagatccattcactcaactaacctaggactgtgataagtcaggatggggacaccaagaccactaagccagggacccttggggagctgtttgtgg

SEQ ID NO: 1274 - DNA, 500 bp, Homo sapiens; identical to SEQ ID NO: 200

SEQ ID NO: 1275 - DNA, 500 bp, Homo sapiens
cctgacaggggcctggtccggtatggggtgctgggggccaggcctggagtcccagggagcccagctcaggtgagagaaaggttcagcctctgccatactcctcttaggtctcacctcttccctggggccaatgtggggccctccttagctccacaggcccagacattctagccccgaccgcctgtggcccccatcccaagaacccggggggctccgaggcttaccattggtccgcaggcccctccgtgccgggcacccacctccagctctggctgtgtcgagcgagaagtgagctcagtgctcgtctgcagtgaagggtggcccaggcttccgcttcctgcccacataccccacctgcccctccctgctgcaggacccctggtccacaccagaccctccccagtctctctggaggaggctgggctgccgggcctgtcctccaaggaagaagcagcaccaacttgaagctggatgcagccttgcatgtgttctcaggtctt

SEQ ID NO: 1276 - DNA, 500 bp, Homo sapiens
agatgtctaggaggctctgaatgagcgactgtgacggccacctgtaagtttcacggcaacagagttgtgaggtggcgacttcagtacctttctgtcctccctctggatagtctcagtccccacaggaggcccttctactcttgcttagtggacaacgctccaccagcccagactcaatgctgagtggggacaaagctggtcatctcggcggtcacacagagttcacttaccgtagtccataaggcaccccgtcccgaaaagcgccaagtgcacgaccatcggctttaccgcctgctcagcacgcctaatgcccgccccggctgcactgggctgagcaaggaccagggcctctgagcagccggctcacaacacactcttatgtcctcgtgtggccactctggaagtaagcagtcacagctcccaagcgtggtcaaaactctgcagcacagatcaagctagctctcagctttccccactcccaaattagcatttggttttct

SEQ ID NO: 1277 - DNA, 500 bp, Homo sapiens; identical to SEQ ID NO: 747

SEQ ID NO: 1278 - DNA, 500 bp, Homo sapiens
atactcgcagctacccctcagctgacccgagctgtgtgcccggctgaggccacaggcaaagccagggacactgtcctcaggctccttacgagaacgacagaggcatctccagcgcgtcaccgagccctaaatagagtagcccagccacggcaccccccaccaagacttcttggactgggcggcagcacgcggccaggccaggcggccggacaggtggggaggtctctgtggctcgacaggtggggaggtctctgtggctctccacgcccccattggtctgaggaggactctatgccctttctgagcaggggcccagcctgggggaggccatttatacccctccccctgggcccaccagcccaactcgccgctgccggcctgacctcgctcccagccctgctgcccagattctaggtgaggcccagcccggcccgccgaggccgggggacagggcgtggctcgagctggtttgagggaggacttcctggggcgggggtctg

SEQ ID NO: 1279 - DNA, 500 bp, Homo sapiens
tgcgaagaaagcacagaacccatgaaacggaacagggcccaggcagcccaggagcctggaagggggcagtggggcgagatgcagcccaccagggttcgcggcagcccagcccttcgcccccgggaggggctggccggaggtctgagggaggaccccaggagggaccctgaaggaggggaacaggaaggctctgggcgggacctgacgcgtgggtccttggcgaggaagcggggttgggtcccgagatcacgtaccagctcagagtggccctcacgcagcccgctgcagccgtgcggcctcctccaacatgcgcatgtcgcgcagcacggccacgacgagctcggctgcgtagtcctcgtagtaggaggcgaccagcttgtcggtgaggtccacgatatctagctgcccgagcgcgccccgcgggatgcgctcaaagccctcgcgcagcggcaccgtccccagcttcatcttgaacttcttgagctcctccggtgtcaggt

SEQ ID NO: 1280 - DNA, 500 bp, Homo sapiens
gttaagtagttatttgcagttgttccgggtatttctcattagaaataacatcatctaaagaacgatattgactgatttttttaatcttggagtcatggacgtgaaccacatatttatatgacattccctttaactagaattctcgcgctttatttttatattattgatctttttgacacgaattgctttttggccttgtgcgaatgttgtaagctttccgcctgcagaggaatgggctggcgtctgggccgggctgggaagagtgatcgctccagccgcgtggcagtaacattcccgcacatttaacaacaattagtctgtgccgacgccatggtaggctttcgtgtatgaaaatttacaaggcttttaatggactgcattatggaaggccgtgcggggccagtcggtggggagataaggccgctgggcgtgcatccatctcatggctcagtcggcccagtgtctctcagtgctcacgtctgcctcctgggaggtgggag

SEQ ID NO: 1281 - DNA, 500 bp, Homo sapiens; identical to SEQ ID NO: 541

SEQ ID NO: 1282 - DNA, 500 bp, Homo sapiens; identical to SEQ ID NO: 560

SEQ ID NO: 1283 - DNA, 500 bp, Homo sapiens
aagaggagcctctaaatttacagggaatacaaggaagtctactgttctctgctcctctctgggttattagggcacatgggagccctcagttgttttctgctgagcaagagcaaagtccaccttggacttagacagcttgccaaattttttgccagaaggggacctgagttgtgaccactcccagtgtgtgccgggaaaaggctcgtactggtgccagaatctcttactgtcaatgctcccaaaactcaccgcttgcccccaccccttttgcttaaatgacgtggttcttatctcagatcctgatataaagctcctacagctacctggcctgagaagccaactcagactcagccaacaggtaagtgggcattacaggagaagggcgtctctaacatgcactgtagatctaaaatcttcgggaagatacagcatgagtttctgtccaagaggttttagctgtaatgaagcctcagtgggatccaaagttgtttttcagttac

SEQ ID NO: 1284 - DNA, 500 bp, Homo sapiens
gtctattggtgaatattgccgtttgagaatgacttttttttttttaaaccataatgatgggcaatagttcagaactactgaagtctggctggagagatgaggaacattactttttaatactgcttgaaaagagaacactttttttctggaagcccatttttctaaaagaaacaataatttttttttccttcattttctccgcgcctctctaatctgccaggaaataattcaacgcaattcgggctgaagcgtgtgcctcgccgcctgcggttgggtcatggccccttctgagactgctcggaagtgggagaggatgcttgcccttacgggtgttctgcccctgagactggcgccccttggtgctccctctgttccctcccagatcttgggagaagcacggacatctctgtttctgcttttggtccccgaacgcagttacgcgcccactggctccctgtctctggcgcttctgggcacgggggagctggggcggccccgcc

SEQ ID NO: 1285 - DNA, 500 bp, Homo sapiens; identical to SEQ ID NO: 874

SEQ ID NO: 1286 - DNA, 500 bp, Homo sapiens; identical to SEQ ID NO: 878

SEQ ID NO: 1287 - DNA, 500 bp, Homo sapiens; identical to SEQ ID NO: 928

SEQ ID NO: 1288 - DNA, 500 bp, Homo sapiens; identical to SEQ ID NO: 959

SEQ ID NO: 1289 - DNA, 500 bp, Homo sapiens; identical to SEQ ID NO: 950

SEQ ID NO: 1290 - DNA, 500 bp, Homo sapiens
ttgactgaagcccatgcagaatgacgggaaagctgagagcatgggctcggcgtgcacgtacgcccttactctctgccccagcttcatgctaggctgctctgttgctctgtgaaaatgttttgaaatggtacctccgtgtgtgtgtctgttgtatgtgttttctccccaaggagaccgtaagtcgcattatggcagtgacgactgcttctgttttctggaagcctccatagtgattagcacagtagtttgcgcgctctgtgtactccacactgcacgtagtggtgtctgtaaccccggggtttgtgaatggcacgtcccattttaaaacttaaaatgaactgccgattctgtgcatgttgtatagcttgtttttgaccatcaggcaagagaattaattccattttgcttttaattggcaccaggcagacattctggctgattttagttgaagctcacataaactttcgctatccttccttctgtattccccagtactctga

SEQ ID NO: 1291 - DNA, 500 bp, Homo sapiens
tattttgaaaaagtactcaaaagtccttcctgtcataaaacactggatagaggaaagctaggaaaagtccagctttaatttcatgaatttgcacttgcaaaaacacatatcttcaccaaaattaagaagacttgagaatttggctctaagcaaaattccactcctgggattgaatgcagatttctgctgtgggcaaaacctcactattatttctagacaatggggctttctgtagtgaaaatggtggcgcgctctgcacatagaatggccacaagccagttcccagttttctccagtggatttgccagattggagaaaggagagaatattttcatacagactggtaaggtctgatgaaacttgggggaaattaagccagttaacttatttttttaaaagtgaatgatggtctgaaagctcagagaaaatatattaaattgcttccaaagggcacagtagagacagcttctccttaaaatctggaagggagctgtcctcaa

SEQ ID NO: 1292 - DNA, 500 bp, Homo sapiens
aattgttgctgctattatttttactactcaagaggaaacatttttggctgggtgatttaatagagaagtatgctattgctaagtgattcaagttaggaatgtatacttgtatcagttttagatcagcctggggtaaacagcccaatgatatatcaggtagataactgaagagtgacacccaggaggtggatggttatgaattgaatggaaacggtgctgcaccagatagccaccaggtagctactatatcgtattcctgatgccagcatctgggggatgattgctcatttcaaataattcaaacaaattaaatgtaagccacagttctttgctatgttacagcaattatatccctttgatacagttgttacatggcaggtgaatacatttttttaagaaaaaaaaatttcaaactgggatcaaaaaaattaccctgaaaccgcatctaattgtctattgtcgctgattccaccgtggttgcagtgatgccattatcatga

SEQ ID NO: 1293 - DNA, 500 bp, Homo sapiens
ttttggcactgtcgtggcaggccgttgctctgatggtggtcccagccaagccccggttgctgactctgcggaccagcactttggaaaccgggatttttgttctgggcatctcactcctggagggttgctggtgcaccacgggatggctagatggaaggttggtcaggtgcttgatgctaatagggatcttagagtccttcagcaagctgcctggtgttcgcagtggacaggtgatggtgcctggagatacgggctttaaccgggacagggaggacgtctcctcgttgtccttccctccaggaagggttgctggacttccgtccgggtcagcatagagatcatagagcgcgtccccgctgtagctatcccgggggatgcccgccttcttcccgctgctcgagctgtcttcctctgggcctggcgtggtggagtcccagtagccctcgtcgctgttggggacgccttcctgctgctccttctccgggtgcttgggctcctcc

SEQ ID NO: 1294 - DNA, 500 bp, Homo sapiens
ttggaggtctagaaatcagggggcagtactgtgctggaaaatgtaaatttgggattatattgatgcaaaactgtgttcttctatgttgctgaagatttagtagcacatatattatgaaatgatattgcaaatggtaactgtaaaacagacattatagtagtcatgagctatttttttccacatcagtatctcagctattaacccctgaaagattgtttgaaacataattgtaaaaagaaacgaatgcctcgtagaacacagtttctaataaatacagcatttttggtgtgcgtccatatcatcatccctcctgtctgcttatttcaaccttttctttgtcctgatgtatttaagtgagaaaatgggttttgtgagtggattcttactatggatattttaagttcagaagtaaccatcctataattgcatctatccttaatgactaaaagaggaccttttggggtgtgttttattgatttctctataaaatttgccaatcc

SEQ ID NO: 1295 - DNA, 500 bp, Homo sapiens
ctgcggctgggtcctgagccttcctggggggatgtcagtgccatcctcttgaagggaaactgtgagcaggatgagaggccggagaagcaactgacggctccctgcagagacccatcaattgtcccagtatgatttcttaatcatctggcaagtaattagccggtatcctcattagcacgcaggagatttgtaaaagtttcggggaggaggcggctgcactgagcgagttttaattacagacgaaccgaccggggacaggcgccttggcagttgtgccgcctgtttacgtttcaccagttcttggaaatgaaaagcaaaacgcttgtcactcatctttgtgatcatcccgagagacagaaaaggacaaggggaacgaaaagtgtggggtggccggtgttgcccctggatgagaccttgagcggtaacggggtatggatcttgggggacggggtctcagtccatccgactgctctagccatgtgccacggactgggtgggat

SEQ ID NO: 1296 - DNA, 500 bp, Homo sapiens
cgcagcgccaagagcagcagcatctacttctggaacagagcctggctggtacttttcagcccttctcgaatgagcccagacggaccccaaactctgcccgctcttgctcctgtgaccccaggacactcccagcaccttgggctgatctcttttccccactgctatttctccgttagccagatcccttcctgctttccccaaagcacccgggccggccagagtgttggtgcgtaagtgcgggtaagcaggcggtgctagagttttatgtggtgtgcactgtgtggctggggctgctggctgtgtagcgacaggcgtctgggcaagtggcctgtccactgcagggagaagtgacagggaggcagggctgtggtgggcattttggagagcttcggagcctggctggtcaggatgaaatcccggccccgttgctcaccggcagtggggtcttcgttggtttgggttgctcccgcattcacatccctggcagttcccgagcacac

SEQ ID NO: 1297 - DNA, 500 bp, Homo sapiens
ttgaaatacacgggagccctttgtaagctgctttataagctgtgaagtccattgttgctgctctctgcagccagcgtgtctctaacctaagtaatgtctacttggctctgggccaggacttggtattggaatctggcgtaagcagcaaagccgcccaccagagtcactagcagctgttgcaagttggaggatttgcagaaattgagattgctgttcccagatattggcacttgcctggtgatgaatgaccgagtctgtgcaaagggactctgtatgctttccttcagccttttattctcagccctctattgtggcgcctgctcaatggccccgttgtggaggagggtggctgaatggaggggtgagtggcctgcctctactgtcattccctccctcagttggcctaaactgagtcattaataatagctctttgatcccctgaaccggttcttggggcaggaatttcatggcacatagcacaaatgccaaaggctaagaat

SEQ ID NO: 1298 - DNA, 500 bp, Homo sapiens
agtgaaaatctaatttcttgagtctaagaactgctgatcttggcaccgagatgcccgtccgtcgggcaaacagacccagagccgttggattattcatagcacggcatctgcagatcaggctgcagtggtgctaatcagagctgaggtttggtaattgatgtgttgagcaggattttagtgggaggggggtgccggcgtcgttgagcgattgtgtatggccggtggggggcccttctgggctgactcagccgcgccaatgggaacggcacctcggcagcggcgcgtctgagcgccagttgtattctgcctgctgcaccatgcaaatgcgctccttcagcccgcagacactcctctgcggccgggtttcttcttaccccctttgcacaggtgtgaaaaccgaggctcaggaaggtcattttcccaaggacattgatcaggggcatggctgggatttgaacttgggaagcccaccttgagcatttgtggtgtcgacccccagg

SEQ ID NO: 1299 - DNA, 500 bp, Homo sapiens
tgagctctgaacctaggtctaacgccaaaactccgactcttgcaaagccatcctgctgcatctgctggacagctctactcgaaagtgtttggctaagttagaatgccttatggcggcgcgagcagagttgagttacaaaaattcctgtagtagcaaaattcccatcttcccacaccgaatggggctaggagagctaatctctatatgatgtaagctcaagggccaaggaaagaggctggtcagagacatcggccagtgatgaagcagctgacatcatccctgctgaaaacattttctgagaatacaagatgccttgtagctggtcatagctggtgttttttctgagcacagagccagcaattcattcccagcactctgcaagaacaacaaaatacgctctctgcaaaaacatcgtggttacaggagaccgagacagcccagcgacagaagctgctaatttctccaagcaacccaaggattggaacgccaagccgtgccag

SEQ ID NO: 1300 - DNA, 500 bp, Homo sapiens
ctagtaatttactagttgaaattgttacatactagttacatcgtttacaaaatgatcatatttgaagaattagctttctgtggatttagtccacattgatgtgagcacctactgtacatgagatagcatgctaagtgctttttatttatttaggcaaaagataaaaagttactgctgctacaatctgtagtgttactggtggagctatgcaagctcgtggatttagggagtccagcctacgagaatggccgcctgtgacagaaagcaggggcgagcgtctgggaatagagctgtgctcatggcagaacaaagacgtgctgtgtttctggcctttgtgttctctccagtggtgaacaaacataggaagctttcatcttcagagtaaacagaaattccaaacccatttcacgcagctttttctagaaggcaatgtgtttaatccacttgttttccgagtctcttagtgtcatcacgacttcctcttatgtcggtgttaatta

SEQ ID NO: 1301 - DNA, 500 bp, Homo sapiens
gaggtctttacggctggacgatggtcgcctgcatcccacccgccgtgacgacggcgtctccggcacaattagccgagcgggaacgctcccagctaattaattcagctgcgctgggcccggtgacgggggccgcctcctaatgaggcagcccaggcacaaagacccctgtgtgtgccccgccccgcccctgcccagcgcggggtggacgcacggaggcacagagggccggccggccaccgtgctgagcaccgcgggggaggctccaccatgccccactccacagaggaccccgaggctcagagagggaggcgacccccacagcccattcatgccgagacccccaccccaaactgcaacgtgaccactgggacagagaggaccaaggacagaatgagatcagggatcatgagaggcatcccagtgctgactgtgatgctgttacaaaaacacaatagtgtccttccctccattttaagtacaattgcatggattttagtgca

SEQ ID NO: 1302 - DNA, 500 bp, Homo sapiens
tctctttggaaaccagctttggctgcgcccctggggacactgtctgccgtggcctcccgctctcctccccggcacaggcagggggtctccctcctccaccgccactcccttggcctcgccctccccgccaggcacctggcttttccccaccgacccccccgggggactgcggcccccagaaaggctgcactctgggagcaaagtggcctgaaaccagagaaaagaacgccgggggatttggcttaaactcgttaaacccaatgaaccctcttgccgaacgatcgcagtctgcgcccggtcttttaatctcgttcgggcctcggggtaatttgtttagctgtgctgatcagctgaaggttaattcaattggacttgggttatttatttgtgcccggatttgctaagtgtcattggaggtacatgaggtctttattatggcggcaagatggcttcattagggtgagggccactccctccggatccgccccctcccgccagct

SEQ ID NO: 1303 - DNA, 500 bp, Homo sapiens
tgtagtagcaaaattcccatcttcccacaccgaatggggctaggagagctaatctctatatgatgtaagctcaagggccaaggaaagaggctggtcagagacatcggccagtgatgaagcagctgacatcatccctgctgaaaacattttctgagaatacaagatgccttgtagctggtcatagctggtgttttttctgagcacagagccagcaattcattcccagcactctgcaagaacaacaaaatacgctctctgcaaaaacatcgtggttacaggagaccgagacagcccagcgacagaagctgctaatttctccaagcaacccaaggattggaacgccaagccgtgccagtctggtggaaaaaaaaaaaaaaaaaaacccaaaaaacaaaaaaacagcactgtgaatatcctgaacacagagacaggcaggtgcccagagtcaacggctccagtcagcacctcctgcacccacaatctaggtaccttcttgaaaa

SEQ ID NO: 1304 - DNA, 500 bp, Homo sapiens
aagtaggaaggggaatcatgagaggaaacctgtgcatctttgcttttgtaaacccagtgtgccttcacgttcatgattataaatcacttatccctgcatcagcctccatccccattgagcgggtgtttagttaaggatgcagattcatactgtttggtttgttcaggagttgtttccatctgagcactaaaatccctctggaggcaaaggactaattgaagcgtcccttagcttgtttataagcagcttcggtttgaggcttctctctgaataacctccagtgagcaccaaatagaaggagcttgctgtttggaaatctaagtgttagcagattttaaatcagtataaaaacctgagcacaagggcactatgtggcctgtacatactgtttatgattaggggaaaatgcagacatatgccagtttacaaaggtgtgcatagatccacacaaacaacacaccccaacaaccattgcagtaaacctgtgtgcccggcagtag

SEQ ID NO: 1305 - DNA, 500 bp, Homo sapiens
agttcttaaagtctaagtattgaaagtaatttgaaaaaaagaaaaacatcccaattatgatttgtgtgtgttgtgatgacttcaaggactgactgggctgcaaatgggctttgaaaaacaagccaatgcgcccgtggaaaagacgggatttcaaagtgtattgttgagtgtgctgatgtaaactcatgggcacgtggcagggcaggcttttttggcaggacctgtggtctcaacctgcagtgatgctaacgatattagcaaattagcaccacaaagcttgccagctaattcaccagagcctgctcactctctcactgctgtaattaaaactaattattttctaaaacatagtaatacatgaatatgtgcaataatcattttgtagtgggcaatctgcggagccttttttaaagctttttttttttttcttggcacataacgctacatgtgtcccgccttggttgagccagcactttcatttgcagaatgtagaatgggcc

SEQ ID NO: 1306 - DNA, 500 bp, Homo sapiens
tccctgtcatagagctgcagggtggattgttacagcttcgctggaaacctctggaggtcatctcggctgttcctgagaaataaaaagcctgtcatttcaaacactgctgtggaccctactgggtttttaaaatattgtcagtttttcatcgtcgtccctagcctgccaacagccatctgcccagacagccgcagtgaggatgagcgtcctggcagagacgcagttgtctctgggcgcttgccagagccacgaaccccagacctgtttgtatcatccgggctccttccgggcagaaacaactgaaaatgcacttcagacccacttatttctgccacatctgagtcggcctgagatagacttttccctctaaactgggagaatatcacagtggtttttgttagcagaaaatgcactccagcctctgtactcatctaagctgcttatttttgatatttgtgtcagtctgtaaatggatacttcactttaataactgttgctta

SEQ ID NO: 1307 - DNA, 500 bp, Homo sapiens
ttgctctaagacgctcatacattggagtcacagcttcgtaaattaaactggaaatagtttgcagacttatcagtcttctgacctgcagcagtgtctctgctatgtttgagatttttgttttggatggtgaaagctagcactccttacaagacatgacagcaaaagattcttcaaaggaacttactgcttctgaacctgaggtttgcataaagactttcaaggagcaaatgcatttagaacttgagcttccgagattaccaggaaacagacctacatctcctaaaatttctccacgcagttcaccaaggaactcaccatgctttttcagaaagttgctggtgaataaaagcattcggcagcgtcgtcgcttcactgtggctcatacatggtaagataagacttggaggtatctacagtgcttttcagattctcgcattagcaccagtgatctagcagtgtagaaaatggaacatttgagttttgttcctaaaacatactgc

SEQ ID NO: 1308 - DNA, 500 bp, Homo sapiens
ctccatccaggctaattagacatctcatttctttgtttccaagctaatttcagcaatagcagatttattagcttgtttaaacctcaaacaatgggtaaagcagcaagatatcccattctgctctgttgtttgaaaatatatttcaaactgagttgttcatccccaaagaccttgtcttttcataaatctagtgccgtggaaaatgatgcccaaagtgccgagcgtgtctgtctgaagagcgggggctgtcgggtctgctgtgcccgcgttctggctggcacattcctgcccggaagcggggcggggtacttgcaggcagcggctgccatatccccggaaggaaggacttcttcccttcataggttgagcacaaagcgccacgttgtagggagggtggggagggccgccgacctctcacagccactggtggggcagacatcctgcacacccctgggctgccgtctcaccccaaaagccttggctcgcagccagattaatga

SEQ ID NO: 1309 - DNA, 500 bp, Homo sapiens
ttttaaaggaaaacaatatgtatatttacagagtgactgaatgtataaaaaatatccctcaactgacactgcagcaaatttctggtgcatgcacttgctattgaatatatatttaatcctaacgttgactttttcttaaaagaaaaaggaaaaagattccaaagtcagccttttactgatttaaataacatcttaccgtggtgtcgtcttcaacatcagcatctcattttctctgggaaacttaaaggtcgtcttgttctgtagagtcggaactgtttctggctgtgggctgtgcttgcctgctcagctgcattgtgttgctgtgagctgaagctctgcaaccacctgatcagtaccacataggaggactgcagagctgtcgctggtgctgactcaaatttatggcaagaggtgcacacgcaacaaaatggacaattttttaaaaaatttgtggcatcaagcgtacctatatatctgatttgctataggatgggatacct

SEQ ID NO: 1310 - DNA, 500 bp, Homo sapiens
ggactccacgtaccccagctgggtctcattgttccagaactgcattagttaagattacccagacttggatttcaaaggaatactttcattgttccgtctgtaacacgaagtaattggggccagctggatgtcaggatgcgtgtggttaccattgtaatcttgctctgcttttgcaaagcggctgagctgcgcaaagcaagcccaggcagtgtgagaagccgagtgaatcatggccgggcgggtggaggccggagaggctccaacccggtcaaacgctacgcaccaggcctcccgtgtgacgtgtacacatatctccatgagaaatacttagattgtcaagaaagaaaattagtttatgtgctgcctggttggcctcaggatttgctgcacatgctgctagcaagaaacaagatccgcacattgaagaacaacatgttttccaagtttaaaaagctgaaaagcctggatctgcagcagaatgagatctctaaaattgagag

SEQ ID NO: 1311 - DNA, 500 bp, Homo sapiens
ttcacaggcgcctccagagccggctcccgctcccacccgctcactcctgtttatgaagcgaagggtaagtgtttaattagtcgcctaattgcctgggtaattggagacgaactcagctctccaagtaatcagtcggaacagcctcgaaaatatctggcccaatattcattagtgtggcttgatcgttaaacagttaccgtgtttggttcatgacaaggcccagcaaacagctgcgcgcccaacagcccccgccagccctggcagacaaacagctccacgcagacggacggacagccggccagcaccggggcagagatgtgagcggccagcggggcacagacgcgggcggccagcggcacccgcacgttccgtctgtgccctgtccggctgccctttcccctgggccccccggtctccctggagctgcagaggctccctcggtcagttgggccacccccaccccgccagcctcctttgcccccagggagcccggtggctgg

SEQ ID NO: 1312 - DNA, 500 bp, Homo sapiens
cccgcacaagccccccagcccgagcatgcaagctcacaccaataagggaagcatgtttctttttcctggtggccctggccctccccttcctcactcccgcctctcccctccccatcagacccatcccccacggagctttgtgtgagggatctcatcgctgtgactcctcggagaccttggcagcctcgcacgccggggcaccgcttgggtcagaaaggacctcggaaggctgaaaaagtgggtcggagacgggctcgcattgttcccgcatgctgtcagccgcagtcgccaactggcagcaggcgacgtgtagcagatgtccgggaggacaaaggcaggcacggtccccaccagccgcccgtaattgacggcctttgtcagccatggcagagctgacgctccacctcccacctccaagtcctcctcactgcagcccccacagcctcaggcctagggggtcaggcgcagcgggggagatggagtttgcagttccacttgca

SEQ ID NO: 1313 - DNA, 500 bp, Homo sapiens
aacagcaaaatctgttccccgtgtatgatctctgcagttttacaataccatcatcatggcaagttacatgaaacttttaagcagaacaagaaagagaaaaatccctaccttgggttttctttcaccccttcagtttctgtccactgtaaatagctgcatctttagcagtccgggcaagggcatctaagctgacagacacaaaaatgggctttcttcggctggctggtgttcccagccttttatgtggtgcgtctcgggctgtgctgcttaattcattcctgattctactcaaaggaagtccagcctggcgaggctgacgtgataggaactgctgaagacacttttgactgcaggggcaaactaaccatcatgcacgcatcaacaaatgtgtaattacatttcagggcccaaagattcttgattttaaaagccaatcaataatttttttttaaaaaaagtcccaggacaaaatcaagcagtttagttgtgatcttggaaaa

SEQ ID NO: 1314 - DNA, 500 bp, Homo sapiens
cgcagccgttagttctcttggtcttaacttgttgatggcagatgggtggcttgttgcagagaagagctcctggagcagcatgagtgcatttactgaaaagcttttccgagaaacggcacaagaatggatttgcttatgtgctgcgaccacacagaactgtatataggctgacgtcaccggatgacgtgtcttttgtttgggttttccagaagctttactgttataaagcaccatgctttgtaacagcatcggggtcgttgcaggaccccctgattacaataaagcgagaaagaagaactcctgacttaaaaacatgatattccttcagtgtaggaagcagcagtgaggttgtaataaaggctgcattcaagaagacccatctgaacagtgagttgggttagcagagtgatgatttttaatgcttgtgagagccagtgttagactgccgattctgcatagagagatcatctaaatgggcagaagcctgcacaatttatgaa

SEQ ID NO: 1315 - DNA, 500 bp, Homo sapiens
ccaagagcttgcctggtgtggagcagcactgatttctcacccctggaggctataactcatgtctctttttctcccattctagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtgagtcatttgattaaaaacaaaaaaacctgtatcttgtttctctggggcatctggctgcccggggaatattatcagatgaactagttgtaggtatcaaaatggtagcctaggctttcctctgaacttgatgatttttctc

SEQ ID NO: 1316 - DNA, 500 bp, Homo sapiens
cctattgtcggggccggaggcgagccgacgcagcatcagctcgtcaacgggaaggaagatgcctccctgcacgcccgccgcgcacagagcataaagaatctgcgctgaggaggcaggagaagaaagccggtgagtcgggggcatctcccccgtggattttccgcgcccccggggccgggccagccgtgctgcaggccctgtgcgtgcggaggacggtgcccgagtcagcattttgggtctgagtcccggcgttgccgctgcctgtgcgctgcacagatgctccgggcagcaacacggctggtgccacggcccggggaaggcgtgcggctgcagcagctcccagcaatgtcaggggaaacgcagtgagaggctgttgttttgcgggtgacagatttttagaaaaataaggctgtggagggaccttctgagcgaggcaggggctgctggagggacatgctcaccccgaggacggatggtgtgtggcccaggcctggtggatg

SEQ ID NO: 1317 - DNA, 500 bp, Homo sapiens
acccttaagcctgctagcctgccccaggatcttaaaatctggatagtctcacggggaggagatcatacaggctggaagttcgcggtgtgttgaaaaagggagggcagagacgcgaaaacgcggaatttccagcccgtgtgcaaattctccaagatgccaaaatcagtacggccattgggccgatgtgagtccagggccttctctctgttctacagaaaagagggaaagggggctggagaggcagggtaacgcccgtgggtgcctcggacacccagctctcccaaggctcttaagcgcgcaacagcaagaaccaggacgtcagagtgcttcctgggcctggagcacggtccgagctgcgtcccccgctgcagcctgtcgagggcgccccaggcccaggcagggggcgagggtaatgggctggaggacaccgtggggcctgggaacagggtgcgagtgggttttgctgtgaggcggcccgggccgggtggcagctccaggag

SEQ ID NO: 1318 - DNA, 500 bp, Homo sapiens
ttgtttcaaggacattttttttggctgtgtattgcacaaacaagtggacacccgggagctggccctgctcgtcccctgggccctccttccctggtcctgcaggtcttgctgcttgtcaggcctctcctccaaccctctgccacatttcagaaaagctgagaatcccttggagtgaaaaaggaggagaaacacagtgtccgtagcccagaaggaggttaaatactttcacttctcttttccccatttgggcggagccctttctgagtcagtctgtcggccgacttcctgcttggggcctgggcagccacactgcacgcaggctgggccgactgaggggctcagaggccaggctctgaggcccacgcagggcctagggtgggaagatggcaggtgggggcggcgacctgagcaccaggtgagtctttatctcccttcctttaacctttatctctggctatattgcagctttcatgcctttagttcagtttgtgcctaaggct

SEQ ID NO: 1319 - DNA, 500 bp, Homo sapiens; identical to SEQ ID NO: 964

SEQ ID NO: 1320 - DNA, 500 bp, Homo sapiens; identical to SEQ ID NO: 966

SEQ ID NO: 1321 - DNA, 500 bp, Homo sapiens
gtgtggggaggtcccttgcctttgcgcgcgcgcacacacacagacacgcacacacacagacacacatacacacaacacactcacaccatatgctcacacaccctcacctccttcagcttccgcacctcccagccacaggctcgcgtgagtgggaaggacctgaggccgcagaaatgtgggttagcgtgggcagcaggagatgctccccgcacccctcctcccattcctacctcccccagccctttctagcgcctcttggaggggaccgggcctgccctgcgctctcaacctaattcggcctcggagggtcctcccccacccagggcggcactccccaggccggcactcgcgccactggcgtgggactaaggctccctgcagttgggtctcccaagcccacttccaggggctgagagaggccaggctgccttgcctgcccgcgcgccctccagccctcgggtgtagggaggggagcgccccctcacctccaaggaaatctg

SEQ ID NO: 1322 - DNA, 500 bp, Homo sapiens; identical to SEQ ID NO: 965

SEQ ID NO: 1323 - DNA, 500 bp, Homo sapiens; identical to SEQ ID NO: 967

SEQ ID NO: 1324 - DNA, 500 bp, Homo sapiens
gtggcactttgagcacgggcccctcttctaagcctcagcttccgaatctattcagtgtagtggttagacgatctcagaatcccttcctccctcagattccctctcccttcttcttttcacctcttgggcgattttgcccgcccagacttgacattggggcggggctggggggagagccgcagcggctgtgtctcgacgtctctaatcgccggcatgcgtttctctgtttgcctctgcagccgtgcagcacgagcgggggcctcggacgtccaccatccgcaagcaagtggccctctacttccgtggacacaaggaggagaacggggccgccgcgcactttccctcggcggcgctccctgcgccggccttcttcaccgcggtcacgcagctggagccgcacggcctggagctggccgcggtgtccaccactccagagcggcagaccctcgtgagcctggctcagcccacgcccaaggtcagcggccttgctgggcccaaag

SEQ ID NO: 1325 - DNA, 500 bp, Homo sapiens
cccggcaccccgtgcccagcccaaagggacccccggcccccgcgccacaccgcggaaggtggcgcccccttgcctggcacagcccgcggctccagccaaagtcccgagccccgggcagcagcggtcgcggagcctacaccggcctgccaagacctcggagctggcgacgctgagccagccccccagaagcgccacaccgcccgcccgcctcgccaagaccccctcctccagctcctcccagacctcgcccgcctcccagcccctgcccagaaagcgccccccggtcacccaggctgctggggccctgcccggccccggagcctccccggtgcccaaaacgccggcgcgcacccttctggcgaagcagcacaagacgcagagatcgcccgtgcggatcccgttcatgcagaggccggcccggcgtgggccgccaccgctggctcgggcagtcccggagccgggccccaggggccgggcggggaccgaggcgggcccggggg

SEQ ID NO: 1326 - DNA, 500 bp, Homo sapiens; identical to SEQ ID NO: 968

SEQ ID NO: 1327 - DNA, 500 bp, Homo sapiens
tgaccctgcagcccagattagaccagagtgactccaacttacactttccagagccttccacagcccaaggtgccagagttcccagggcaagcagcaccaggaaggggaagaggccgctggacttcatggtgaaggcaggagtgactctgatggccaatgccaaacctcactatttattctttcaccagtgggtgtggccccaccagaattctttcggcctctcccagctactattgcataagcaggaaacgtagccagagaccagaaatcctgacaccaaggagattgtttatctttcctatgccaggtaaggctatgaggccaacacagcaactatcagaaaagaaagggaagagattggcctgggaagttggttgattaaagaggccatctcagtgtccatctgagccctaaacatcacaagatcccaggccattagccttataggtggagagagggaagaagtggtcaattgcaaaggtgctacccggacctggaac

SEQ ID NO: 1328 - DNA, 500 bp, Homo sapiens
aggacagctgttggtgtgagttcaacttgccataacacacgtgactttcttgttttggatttactgctcagctgaccgggacactctaaacatagcagttgttggtggctgggattaactatttcctcatgatctgtgaaccctttcacccctcagccttcctctaccttcaaatatgtcatgtcaaaaaaggtgctttagaaaataaacactccagggtaaacacctggcttacttttaaacatcagacgctgtggtctcacctgtcctggcaaggggcctctgccggctgttcccatgactggctcagggtctgagttcttattccatcaaccttgatcaaaagaaggaaagggaagaaaaaggcccagggtgacaaacggctaaatattttcatttttacctcaatttcctgtcccaagatgggggatacctctgaccagaaaagagaaggaaatcctaacttttctctagtagtgagttgagaaataacattactt

SEQ ID NO: 1329 - DNA, 500 bp, Homo sapiens; identical to SEQ ID NO: 970

SEQ ID NO: 1330 - DNA, 500 bp, Homo sapiens
tatacagtgatgccaaaacagacaaggaagggaagtcaagattaatagtggtgagcagggcgttgatttcagccagttctgtttacacagcattttccttccagaaccgcagagctctacacagatactatctcactaatcctcaatggagctttctcaaagcgcctttatccagcctctctcctaggagaaagtgaggcacggcgggcagaggtggtgaagtcctcgcaaaagctggaaacatgaccccgggctcctgacgcatgggccattgtcctttgcactccaccgcgccaccttcctgtcaggtgtctggtaaacaggttaactgatcgctgattaggggcctcccgcctacgtgcaatgagtggcggaaaggagcttttccttgtcaatacgaaaatctttgagtacaaatcgataaagctagagattcaaagactgcctttataaaactggagaagatgcactctggccataggcggagggggcagcccggg

SEQ ID NO: 1331 - DNA, 500 bp, Homo sapiens
ggctcgttccttctccagccggctctggcccacgcgccgcgccttctgctgcactgcttcctcggccacctgcgtcgcgtgctgcagccgtcgctcccccgcccgggccagcgcctccaggtgcgcctgatgttcccgctctttgcgctctgccgcctccttggcccgccgaccctgcagctcctctcgccgggcccgctcccgcagctcccgggtgcgctgctccaccaaatgctcgtagttctcctgcgcacggcccaaactggcttccagcgagctccgcaggccctctcgctcctggcgctgctgccgggtccgaccctgtagcagcgcctcgtggcgcgcccgctcggcccggctcagctcccgcttctcccgctgcagctggccctcctgccgctgcttggcgcgggccgcgcgctgggcgcgctccctgcggatctgctcagcccgctcccgcccttcctgtagaccttcctcacgttgcttcaggttctgct

SEQ ID NO: 1332 - DNA, 500 bp, Homo sapiens
tcttttccctgtaacctctgcccccaagaggcaagagttcagcttcaaaggaaaagcaagcaagtcaaggccacctcagtcccttctccctggatatcccctctctaaaccgctgcctattctaaaggccaacgacccggtcctgcgatttgtcccgttgtagacctgggaacaggcaggcgggaactgggggctttactgggggatttgaggctggggagggggagggagcaaatgtcatggctggctcgctcaagcatccagggaaccgaagctaagcgcatcctgacgggcttttaaaatgacattgattaggacaagctgttcccaaccccagtaagagttaatctgcctgttaatcaaggcactaaggggctcaatgcgagttttattagcgacaggagaacagaggcggcagccagggatcaaaagccgggatcccatatatttgtcagcgctatctccaaaaaaaaaaaaaaaagtattttcaatttgaaaac

SEQ ID NO: 1333 - DNA, 500 bp, Homo sapiens
ggtcaggcgcatgccgggcccaacttgggctcctcccaggcccacgctgctccgatattgatcctgggagaaagataaacagaaaagctggacattcagtcatgaatactaatgagccagggtaggggttttaattgctgtggacttcctttctccagttaatccttattgcaaacttcgctggagtcagctttctcgggcctcccgcctccttgtattttcctgtgaaatacccaggcgaaagagacccgtgacaacttgactttctcctcttcgagaggcccgtgtgagctcgagagcccacagcccgtgtttccagtgtgactctgtttactaattatggaaatatagggatcctataaaataaattgtttcaatatggctttggcgagtctgcttcttgacttcttcacccttattgtttcaaagacttcgtgtgtccttggcctttaaacttcctcttgacaatttcatcttttctcccgccacggagctccttt

SEQ ID NO: 1334 - DNA, 500 bp, Homo sapiens
actcggccacggcgcctcccgccggtccttgccatctgaaggccgggaggagtggggagtcggcgcttgcaaagatacactcaagactgcagacagtaaatcaattttatttgtgttcacagaacatactaggcgatctcgacagtcgctccgtgacagcccaccaacccccaaccctctacctcgcagccaccctaaaggcgacttcaagaagatggaaggatctcacggatctcattcctaatggtccgccgaagtctcacacagtagacagacggagttgagatgctggaggatgcagtcacctcctaaacttacgacccaccaccagacttcatcccagccgggacgtcctcccccacccgagtcctccccatttcttctcctactttgccgcagttccaggtgtcctgcttccaccagtcccacaaagctcaataaataccaagagacctgcatttacagcagggggaacatctcacacccttgcataagttaaa

SEQ ID NO: 1335 - DNA, 500 bp, Homo sapiens
acaaagaggaggaggcggcggcgggcggcgaactgagggcagctcagggggaggaggactcattgtccggtccccccagtccaattgatatgctaatctcttttctgatgccacaacaaagaacacctttgcacttttaaaagacttttgtgccctggctacagaagtttattatccactaattagcaacaacttctggcaacgagttgggttacattttcataagttccaggcctgagcgacgaggtgcgcagggcaggaggaggtttgagagcagggcaaacccgaaacctggcgctagaaaggaatcacccgctcactttcctaggcatagggcgccaggcggggatcgaaagcgaaaagtgtccggaaaaaggttcttaaggctggggatggggtgaggtggggtggagttgatcgatttgggcccagggtggctgatgaccttattggacccgattctgtgatccccatcccgagagctgcacggaggcggagac

SEQ ID NO: 1336 - DNA, 500 bp, Homo sapiens
ggagggcgatggggactcagggaaggagaaggagggctcaatgagggggtcacgggcgagggataaggccttggtgaggaagtggaggttcagcgagggagcggaagctcaagaaaggggaaggggagaaagggttcggagagaggccagtgagcggcgaaggactcgggcgtggaagctctgggaaaaggatgaggtagtaggggatggggcgggacttgcggcaagggacttctaccagtaggtgggcgttggtggggcggggcccaggacggggcggtacctggagcttgcgcaactgctggagctggccgcgcaagtcactggcgctgttctgcaggcctcgcaggtgaagctgcatctgcagccggctaacggcggtaggctgacctgcgggggtgctgctggccgagggcgggggcgggccggacaccggggtggccccgctgctccggccgcctgacccacaggctgcagaggaccacgaggatgggagaaag

SEQ ID NO: 1337 - DNA, 500 bp, Homo sapiens
cctgtcgagcacgagctcctctaggcggtgcaggtcgcaggccacgtactccagcgccatgtcggtgatgcgtgggcaccacgagaggtcaaggctgcgcagcttgcgcaggttctcggccacgagctccacgccgtcgtcggtgaccttggagcagcccgagaggctgagcgcggtgaggttgggcaggctgtgcaccacgttgaccacgccgtggttggtgatctcccagcaggagagcaggcgcagcgtgtgcgtgctgtggccctggcgcgccgtgaagtaggccagcgccgtgtccgtcacgtggtaggcctgcaggctcagctccgccaggttgggcagcagctgcgagatggccgcgatggcgtcgtcggccacgttgatgcagtcactcacgctcagcgaggtgatgcgcgcgctcaggctggaccacagcccggcctcggtgaagtcgttgcagcccgacagctccagacgcaccacgccctgcatctgtt

SEQ ID NO: 1338 - DNA, 500 bp, Homo sapiens
accctctgtccaacaaaagacctacagttccagaaaaccatggtggagtgcaagaacacagaactaaaacagagcttgaaacttaaagaaagggagagacttgggggaggagtggggtggagtgacgtgatgtgctgctggaaaccagcagttggtggtttcctcttgtgcttcctcttctgtgggttttctcctgcttgtgggagggcctttttctctcctcccgacagaaaggctatctttggtgttcgttcccttgaactgtaacatcctgtaagggtatgattccatgcctctgtgtgggtgtgaattccctcatggtgaccctcaaaatctgcacacaggaccccttcccattgaggggaggggatcaaaacaactctacttctcagggtcctctcctgttccaactggtctgtgtccaagagaagccttaggtaaatggggccagcttgaagatcaaacaggtttggcagcctctcccggcctctcttttctct

SEQ ID NO: 1339 - DNA, 500 bp, Homo sapiens
ccattatctaacagaacttcagaatgagggttccttaaaattagcttcaggtccttatgagctgtagctgagcaaatgaaatgcaactgctttagaagggaggagcttccaagatgctccagtggtcttttccttcccttcctcgtataacgcaatcggtggcacaatcccgctaagtagcatggcatgctggctgccggtgttctgttaaattagggtgagtgcttgtctgtgcttcagtttccctttcggttaggcaggactggtcttcccactagctatcatctatagtttacttaactctattatcatatgatgaatcccgtaaagctcttcagaatgttagggaaacaggtcctattatgtcccccactctaccttcatgggtgggatggggggtctgggggtgggaccactgagagtcaaagaagttaggaagtaatctgtgtcacagcaagctccctggaaactctcagaatagcaaacaggtttcctctccg

SEQ ID NO: 1340 - DNA, 500 bp, Homo sapiens
cccttagacgctaaaatccagaaatgtttccatcaccgtccaaactggccaaggcctggcacaagcatcgagttgggttttgtttggttagaatagaagaaggaagaggagagaacaaccagagcagccagtatgtggctggtgaaccccagtccaggtttccgcacctccagtgcagacgtgagagtcagagcccgggctcggcttcagccacagacaagtccggccaccgcaagtaaggcttagagccgggagtcggttcgcaccagccactgctcgctttatttccgccgctgaactccgccctccccttagccaaggatagatattatcaaaaagaaaaaacagaaaagaaaaataccacatcatagtgttccccatccctcctttatctttgtatctcacaacctcatccctgtggtccaaccttagagaatagggagagggagttagcccctctttgtagtccccctccccaaaaaccacagacacacaaagcc

SEQ ID NO: 1341 - DNA, 500 bp, Homo sapiens; identical to SEQ ID NO: 971

SEQ ID NO: 1342 - DNA, 500 bp, Homo sapiens; identical to SEQ ID NO: 973

SEQ ID NO: 1343 - DNA, 500 bp, Homo sapiens
accatgcggtcgaaggatcgcgtgttggtctcctcgcgcaccttctcacgcacgtggaaggaagcccgggctgtggagcgggcgctctccagcgcactgcgccgttcccgcgtcagctgctcgctgcgctccagcttgcgcccgatggcctggagtagctctcgccggcggcagtcttcgtccctctccaccttctccttgttggcgcgctgggctcgttccttctccagccggctctggcccacgcgccgcgccttctgctgcactgcttcctcggccacctgcgtcgcgtgctgcagccgtcgctcccccgcccgggccagcgcctccaggtgcgcctgatgttcccgctctttgcgctctgccgcctccttggcccgccgaccctgcagctcctctcgccgggcccgctcccgcagctcccgggtgcgctgctccaccaaatgctcgtagttctcctgcgcacggcccaaactggcttccagcgagctccgcaggcc

SEQ ID NO: 1344 - DNA, 500 bp, Homo sapiens
caaaaacaaaaccaaaaccaaaacaaaacaaaacaaaacctgccgccgctccggaagagctgggatggagaataaggatgaattctggagggaaatccggcaaaacgggcattggcactaaaataggacattcgttaaggaaacaacaaagatggctgaagaatggagtatggctgaaaaaagcccactggagaggtgcagatagtcccctctgggcgccttccgaggttgggagggcattctggcccccgcccctccccgccgcaatctgtcgggacccgccgggtttccatatgaagggtcgagccggcgccttgggagcgctgaatggccgctcgcggtccggcgggcgcgcacgccccgcggcccgggctggatttggccgcatttgcatagcaggtgctgatgcttgtccattcttacttaaagaagttttaatatgggataaattaccaggaactaggagctgacgtgggcgggaaaaaaggaatcgtgtcgcc

SEQ ID NO: 1345 - DNA, 500 bp, Homo sapiens; identical to SEQ ID NO: 975

SEQ ID NO: 1346 - DNA, 500 bp, Homo sapiens
ctgactgtccactggcagtttgaaacattgcagctcactgataaccagaaatgagtaagcactatgaccgttcagaatgtcacactgaagcaccaataaaaagctcataactttcgcaacagcagagttatgtggccagcatgctggggaaggaacgtttacattacccatctgcaggttacaaatgactgtttaatcagcgtcctccttacctaacttggcctgcttggccctcaggcccgggcggcccgagagcattccacggcacctgcaatgctttccaattcccggaaagcagaatgcagccaactgaaaattcctggagccagttttctcagagatccacattaaaccagaagctacgtcactggagtctgggaggatctcaggttctgagcagagctttctcgccccctcctgctgctaatgagggtcaaggtgcttcctgaaagtgaggcccctctggggaacttgactgccatcaaggtagaaaaccctgg

SEQ ID NO: 1347 - DNA, 500 bp, Homo sapiens
gatgcccgggagttttccaagtttcagattagaacaaaagtccaggcacatacaggactttgctagaaaactccttggtctcttcccttaagattctggtacccaatttcccatgttataaaactccaagtcttttcccccattcggtgcgctggacacataagatcatagagggttcgtagttgtaaacgcacccacctaaaaaattaaaaagagcaaaccaacaaacagcacctgaaaaatctctcacgggctttgaagatatggcctggcgtccacaaaaagaatggagggaagacactggcctctgcgaacccgcctccctccgggaataaaaggcggagggcgggaggggtaacagccgcgccccgggctcctctaattggacctcgcccctcctggcgccccggcgaatggggtttgggggcaggggtgtgagggacggggaggacgaggccagctgtagagggcgaccggctcaaaggggcgagcttttcacg

SEQ ID NO: 1348 - DNA, 500 bp, Homo sapiens
acaccaacaatttccagggcgctgaagggaataataatactagttttaaaagcagggggctgtggaaggcgttatgccaattcttctgggggtttggcccgcatatttcgacggtggtgctggtcgtcagggccagtcctcaaatccatgcccctttctgcgttttgcagcggaggtgcctgcgtggaggcagcaaagtggcaagccatggaaatgtcctttctggagttagcaagggctcttgcggggcgtgtatttccagacctctaggttgcaccccgaaccccaacctccttccaaccccagacaaaggcgcgagtaggttggggaggtgagaggcccagtaaatggccagctaaccagaacccaggttggctgagttaaccgcgctcagctgcctggaggccacgggacccgatctctggggatgctcgagctggcgcttgcggcttcccgctgcgcgtagtgggggactgaggctccaccgctcccccggtgcc

SEQ ID NO: 1349 - DNA, 500 bp, Homo sapiens; identical to SEQ ID NO: 978

SEQ ID NO: 1350 - DNA, 500 bp, Homo sapiens
tgcccggtttctccagttgtgaaactggagatcccgacgcgtgggtcatatccggggaggacaagagacccaaaattgggaaacagtggtgcgccctgacttcggggtccccctcttggtccagccggggaagccgggattcctgggtccctcgggataaggcctcggtggtgggtaaactcagaacctccaactctgggttcctggcatccggaacccaggggtttctgcgggcgggtggggctcaggcggggagcccacaaaccggcctggcaagctctagttccctgcagctggggtggggcgtcgccctgcattttcaggtgccttaaccgacccatttccgcagagcctcctgtcgctgagccctgacgtgcccgtgccatccgaccatggagggactgagtccagcccaggctggggctcctcgggaccctggagcctgagcccctccgactccagcccgtctggggtcacctcccgcctgcctggccgctcca

SEQ ID NO: 1351 - DNA, 500 bp, Homo sapiens
gtggctgccccacgcctgcctggagcatcccctatccccacccagcccaacccatgttctcagcagcagggatggttctaggctggctgaatgagggaccagggcagagactgcaaaagcttgagagccaagggggcagcacagagcggggaggggctgggcttgggctgtgctcctgttgggtttccattaaccaggggaccagctgggctgctgtgatttcactttcgcagaaaatgaaactgaagccgtggtcacgtgacaggacatgtagtatatagcaggctgccagcgactcctgctcttgcttctggatctgcagggcagtcccagcaggacccatggagtgtccttcgtgccagcatgtctccaaggaggaaacccccaagttctgcagccagtgcggagagaggctgcctcctgcagcccccatagcaggtgaggcccaggggtgctggtggaggctggggcagtggggacccctggagatgtctcacctc

SEQ ID NO: 1352 - DNA, 500 bp, Homo sapiens
ctctcctcccgggggggagagcagctcctctcgtggtgcggttgcttgttctcgcagccagaacacactgggccagggctgttgtgtgtaaacacacacacgcacacacacctgcttcatcccggctcccttctctccgagttgcctgggttggcctccatttggagcctacctgctggtgtttatcacagtcggtgttttcccccttccatgttcctcagcaaagctggtgcttatctgagcagcgggcgatttttctgaagtgacctccgccgagcgggagatttatggtggcgtttgctttcattatgtgtggaggctgcctcgtgagctcgctgcgtggctgtcggaggaagagcagaacgcttcccagaataagcctccggtattatctttgaacatatgttcttgattaaatgagaagaggaaagtctcttcgttttttcctatttggaggttaaagtggagggtttctctaaaaacagattgcagtaaattgt

SEQ ID NO: 1353 - DNA, 500 bp, Homo sapiens
tagccgcgcgtggtggcgcatgcctgtaatcccagctactggagaggctgaggcaggagaatcgcttgagcctggaaggcggtggttgtggtgaaacgtcgtcctttgcatttccagttccctctaatggagctgcactcttgcatgcttttgctcacatcttctggactttttttttaagtagtgagtaatactgcacttttgaaacttgctcgggcttttacaaataggtggaaactaccagtgattcggaatgttgcaagaggaaactaccagctcactagacgattctgaccaattatggggctggatacaaggaataaggtcaaagtaaaacggctgacattaaaatagcgtggctacttagagtttatcaaagtcgaaatttaaaaaataatttaaaaaaaaggtctctgtactgccaggcgggcgacagggactggccagctgcgccgcactcgcctgccagattccccttttctcggggtagccggaagggc

SEQ ID NO: 1354 - DNA, 500 bp, Homo sapiens
gcttagcggagctaggcctggctatcttggaatggagatttagaccctcgttgtcattcccgtccctcatccctcaaaacaggaagcttctcaactccttcccctatgcttccatctggctctccaatttgaaagtgacagtggtggggcccggaggggcaggggtcacttgaggagtttgcgggagaggaaggggcggggcgtggaatttcctttaggcagctcgtggagacccagcctgggtggacccgggagtgtgtgtgtagaagcagggagggggacgcctgggccggagagggtcctagggccagtccctgcgcgccttgatccgggcggcggctaagggagagccgagcacagatggcgccgaggcggaggtctagtgattcccgctcccgcccctggcacacctggacaggtgccgggcctcgcaaccggccaggaggcagctccaggcagcccgtctgcccactcctcttagcccggacagctcctagctg

SEQ ID NO: 1355 - DNA, 500 bp, Homo sapiens; identical to SEQ ID NO: 972

SEQ ID NO: 1356 - DNA, 500 bp, Homo sapiens; identical to SEQ ID NO: 977

SEQ ID NO: 1357 - DNA, 500 bp, Homo sapiens; identical to SEQ ID NO: 979

SEQ ID NO: 1358 - DNA, 500 bp, Homo sapiens
gtaggagtcaaagccgccgatgaagtcaactgcggaagaggggcggcgcatgttagggatcggcggcgggggcgaggagagggagactgggtcctgaaggggaagaatctgagggcaggactcccaccctaggaagcggagccagagaagccatgaggaggggaggggcgagggtcagaccccgtgcagggcctggggcggggcttcggctggaccctgagggatgggcctctgggggtctggaggcggcgaggccgggccagctgagggtcaggccccagtccttaaggcttgggcctgggaggccgggcagtcctatgggagagaaggctctcaggggcggggctagagcctctaaacgggacaagacctctgatggggtggggcgagattggggaaagggggtgctggggccagggactgggcacctggacgtctggaccccagcctggaacgggctggtatgcagagccttccataccagccgcctcttcccctcg

SEQ ID NO: 1359 - DNA, 500 bp, Homo sapiens
ggtccccgggctcccggctccatcccgatcagccgggcatccttacctgctgcccaagttctcaccttcccacctgcctccagctccagtggggtgcaggacgcatccatacatcttcatgattactttttccattgcatccattagatcagagcttaaaggaaggactgtatcattaaagaatatttcatctgaaaagaaagagaagaaatgtcaaccaaacgtatctcaccctcctcacttcccacacgatagcctgagcttgcgagtctgtgaggttagacactcccgccaagtttcactgctgttgttaggcgggcgttaaatgtcccttccgtcttctgcatgtgcctgctggtatgatgctcagccccataaaaaggcaataaatgcaacacggctcaaatcgccttgctcactcagcaccagcaacaggaggaaaataaggcaaaggtggggagtttaaccattttcatcgctttctgaggcttttgaatgtg

SEQ ID NO: 1360 - DNA, 500 bp, Homo sapiens; identical to SEQ ID NO: 985

SEQ ID NO: 1361 - DNA, 500 bp, Homo sapiens; identical to SEQ ID NO: 976

SEQ ID NO: 1362 - DNA, 500 bp, Homo sapiens
gaccatcaaagtatgatcagatgttaaatgggcacagcgcagatcgctcttcaccctaaagtgtttttgtgtcagataccaaatttattaatgggattttttcaggtcacaaaatgtgaccccaccctctcatgaatattcaacagagaaccaagggctcttttgcgaggtagaaggaccttaaatctgccagaaagtcccccgactatcagtagagttctgactcttaaagagaaaaggtgctctttccggaggggctggcagagagccccaacggcaggaaatacaaataaaggaagtgctctccaaccaatgtacagggagaaagtggaaagaatcatttcaaaacgcctaagtgactttctttttcccaaagtattaaaattgagttttaatgtttataaacaaaaactgggatgtactttgaatatgcaatgtgtttttattttagaaactaagttcttcatgaggcatccataaaactcatgcatgctttcaga

SEQ ID NO: 1363 - DNA, 500 bp, Homo sapiens
gcagcggaggtgcctgcgtggaggcagcaaagtggcaagccatggaaatgtcctttctggagttagcaagggctcttgcggggcgtgtatttccagacctctaggttgcaccccgaaccccaacctccttccaaccccagacaaaggcgcgagtaggttggggaggtgagaggcccagtaaatggccagctaaccagaacccaggttggctgagttaaccgcgctcagctgcctggaggccacgggacccgatctctggggatgctcgagctggcgcttgcggcttcccgctgcgcgtagtgggggactgaggctccaccgctcccccggtgccctctgtatgtcaccgaacacagccaagtttcctgcgaggggtgtgggcaattaataaactctaagggaagtgaattggacatttcctggcttttgagcctttgtttgattgtttctgcaggcggagggagggggatctcggggacggtggggtggacaagaaagga

SEQ ID NO: 1364 - DNA, 500 bp, Homo sapiens
gtccagtccatgctctcccatgggcctgagagaagatttgaggtttctggctttccctccaaccctccaactcccaccccaagccatgtcagcaaggggaaggggcaaacatggagtttcccccccaactcccatgtaaactatgccccctcttagagggcagagcagctaaggacaattttgtttcaaggacattttttttggctgtgtattgcacaaacaagtggacacccgggagctggccctgctcgtcccctgggccctccttccctggtcctgcaggtcttgctgcttgtcaggcctctcctccaaccctctgccacatttcagaaaagctgagaatcccttggagtgaaaaaggaggagaaacacagtgtccgtagcccagaaggaggttaaatactttcacttctcttttccccatttgggcggagccctttctgagtcagtctgtcggccgacttcctgcttggggcctgggcagccacactgcacgcagg

SEQ ID NO: 1365 - DNA, 500 bp, Homo sapiens; identical to SEQ ID NO: 339

SEQ ID NO: 1366 - DNA, 500 bp, Homo sapiens
agggcagcggctggcattgccggggaagctggtgccaggcatggcccagcatgtcacatagaggaactcggctgcaaagtcagtgccatgagccgtgaactttgtctgttcactgaggcagcctgagtccatgactcacagctggcccctcccctctccacaaacacggaatctcaccggaccccacccgatcctgtgatgcacaaggccggccctctccacaaacacagaatctcaccggaccccacccgatcctgatgcgcggccggccctctccacaaacacggaatctcaccggaccccacccgatcctgacgcgtggccggcctctctccacaaacacagaatctcaccggaccccacccgatcctgatgcgcagccagcccctcccctctccacaaacacggaatctcaccagacagcaccctatcctgatgtgtggccggcccctcccctctccacaaacacggaatctcaccggacagcaccctatcctgat

SEQ ID NO: 1367 - DNA, 500 bp, Homo sapiens; identical to SEQ ID NO: 346

SEQ ID NO: 1368 - DNA, 500 bp, Homo sapiens; identical to SEQ ID NO: 351

SEQ ID NO: 1369 - DNA, 500 bp, Homo sapiens; identical to SEQ ID NO: 166

SEQ ID NO: 1370 - DNA, 500 bp, Homo sapiens
agctgggccgcggttccttcaagacggtctacaaggggctggacacggagacctgggtggaggtggcctggtgtgagctgcaggtgagggtgccccagcccgcagggggctttccgcagggtctgtccgcgagtgcgtccttgggcctgtccttgctcctgcgcctggccttaagaagccctgggggcggcggggctccatgtgtgtcaccctctgtgtggatggctggcaggatgcataccaggtgtgcggacggcatgtggggcctggctgtgtccgtgcgcaggttgcggtttgtgagtcagctggtggcgagggcaggcctctgttgtgcgtttggtgtaagtgtgcacgctgtgggcgtagagagggtcctggagagtgggcctcggaggctgtgtctcttaggctgctgcttctccagtcccgatgacctactttaatgacccagggagtctggactgttgtgtctttgcaaaacagtgtggaggcttcaaggc

SEQ ID NO: 1371 - DNA, 500 bp, Homo sapiens
atgaacttgatcatgagtcaaccaagggcctccatctctcctgcactccctccgtttggccccttggagcaggtgtttgctgagcctgaggtctttctgcttacataacctttgttccatttggatggatgaaaaatctccctgaggtttattgtaaacagtcttaggttcgcccaaacacagaagacgaaaggtcaccagattattcatgcacgtctctcctccccacttagccctccccacccccaccggctgctgccacgtcccccacgaggtcccatgcccaacctctccaccaggccatcagtgtgcagggcctggtgatgggggttcagggccaacttggcagccatgatgctgttccatgccctgctcagcagccattttggctggatctccgtgaggaagggctgggggtggggagcagaggaagtttcttgaccagctgccatggatagaagcttgctcacggaaagactgtcttttatgatgccagaaac

SEQ ID NO: 1372 - DNA, 500 bp, Homo sapiens
ctttaccaggatttttgttttgttttgttttgagtttttatttcttctttttcttttttgttctttgcttttatcaatgaagcaagttgctaggatgcaaaaggagttggggggtagaagggcggggtgggaagcagaggtgggaggggtcgaggttggagcacctgtcgtctgcatgacgtggacggctggttctggttgtattttaaatgaaatctcatcccagcgtagacaccacgtctggaattacgatccaccctgtgatctgtcacttttatatacacacaggggaggggaccgtttccatagagagggaatatcacagcccacttaggaacaataccggagaagcaggagccgagaccccggagcagccacaagttcatggggacgtgcacggggccgccctcctggccctgaagctgcgccggcctccctgagcgtttcgctgcggagggaagtccactctcgggtaagcttgtggctgggactgacttatg

SEQ ID NO: 1373 - DNA, 500 bp, Homo sapiens
tcgtgctcatttgccttctttcttttttgccattcttcccagctactaaatttctccctctccctcagggtaactttgacctaaatcttcagtgcctgcttgcctcaaccaggccttatgcagcggttacacagtcacctccagagcccatgttttatttaggaggaaatattgcccatttctacccgggtaataacctgccagccctatggggccaaagtaaacaccaggcccatggattaaggccttcggcaaggattaggctgcagttcactaggtactccttctgagtaggcccttgtaagcagtgagaaataaactattatgaaaaacaagttcctaatgaaaagataccaggtcctgagatcgaaactgctagtaaacaatttatatctggagggcactctcaatgctttcaagactctgaattatccagcggtggagttgggctgcagtcccacagaggaaaaataaaggctgcttttacatatctggcttta

SEQ ID NO: 1374 - DNA, 500 bp, Homo sapiens; identical to SEQ ID NO: 362

SEQ ID NO: 1375 - DNA, 500 bp, Homo sapiens; identical to SEQ ID NO: 356

SEQ ID NO: 1376 - DNA, 500 bp, Homo sapiens; identical to SEQ ID NO: 355

SEQ ID NO: 1377 - DNA, 500 bp, Homo sapiens
acctttcagtcattcccagtagaaataattgagtcggacattatcaccttgctatgtctgtccatctcgatctcattttctccatttgtaaaaatgatatttcagtccacccggacacaagtcaggatcgcgctcgcaggctgggccaacccacaaggagctaggggtagctgaaatcgctcgccagcctgcagcatctctgaggccgtctggggttttcggaaatttgcatttggtgtggaaagccggcgtggtgcgtttagcttgagcaggggcgccttggaggtctatttccaaggctgtgggcctggcgccctcacgacattgtacctatcccgaaggaaacggggctcagtcacccaaagagcccacgagaaaggccgagcaggagaggggaaaacacacacacacaacagagaaccattgcatttattggacattgaaacgggagcagagagggaaaggaagtgtgtggggaggcggttggtagggtaaagcca

SEQ ID NO: 1378 - DNA, 500 bp, Homo sapiens; identical to SEQ ID NO: 802

SEQ ID NO: 1379 - DNA, 500 bp, Homo sapiens; identical to SEQ ID NO: 371

SEQ ID NO: 1380 - DNA, 500 bp, Homo sapiens
aattatttttctatagtccatacaaattaaataatctggcaactctggcaaatcgccttgtaaaatgcgtctcattttttaacttgctttcgttttgaaccgcccttgtaatcgcctgaaatcgctagttctttatgcggtggctgccgctgtgttccgttattttcagtaggtgtcatatttatttgtattgcctttgttctgttcgccgctggttttaaaccagcttgctgtgtgcatctcagacgtcggttggtacgtcctccgctgttcttcaggaaagcgatagcctcacctatttgaaacaagccctgagaggaaacgcagaaaaacctgagtgtaaacaactccggaatgtcgctagctccttagtaaataaatgaatctctttctggagctagtgtctttgagcgccgcaaataccccttttccatgaatcactaacaatcgcctgggctcgcacgaaggaaaggactcgctcaaggcttctgtttaataag

SEQ ID NO: 1381 - DNA, 500 bp, Homo sapiens; identical to SEQ ID NO: 507

SEQ ID NO: 1382 - DNA, 500 bp, Homo sapiens; identical to SEQ ID NO: 375

SEQ ID NO: 1383 - DNA, 500 bp, Homo sapiens; identical to SEQ ID NO: 363

SEQ ID NO: 1384 - DNA, 500 bp, Homo sapiens; identical to SEQ ID NO: 282

SEQ ID NO: 1385 - DNA, 500 bp, Homo sapiens; identical to SEQ ID NO: 257

SEQ ID NO: 1386 - DNA, 500 bp, Homo sapiens
tatttggtatgaaaagaccattacgtttcttaaaacagtgaagtaacatgaaattagtttcaggaagattcaactgttcatattttgtggcactacaaaaactaattgagcacttactgtgtactgagcactgtcctaaagggctttattcatttaatcctcacagcaaccctttgagacataggtagcccttatgttacagatgaacttgagtcacaggggggtgtacctattggcccaaggtcacgccgtaactgataatgccttggctatgaactggcagtctgattccagagcctatacacttaaccactacactgtgtccctgtgaaggtgaattagacaaagaagatgatccttgcacatagcagtgaaggaatggtaatggatcactttttaatcctgttaatattttaattaaaaaagatcttctatcttcacggtaccccgatacttttcgttttaagttcttgtcaccatgattggttgtatgattttgg

SEQ ID NO: 1387 - DNA, 500 bp, Homo sapiens
gggtgggacctgcctgtggccccgtttgcttctgttggggggcagctcccggaggctgctcggggagagcagcagggtgggccaggaaaactgcaggggcctctccttgttggcccgtcagcctgtccgtctgtgtgaccttggggcatgctctgaggggtgtgtcccaggctgactcaagacagctaagccagaggtggggacgaccctggtgcgttctgggagccggcagtgcatcctgggctgcagcggagcgagagagaggagcccagagccggcagcaggagtttccgtttccctccgagtgcatgggatgctgcaccgtaggactcccccgtccagacgtctccgtttccccatggcatccagcccctgatgctcagaaattagcttcctgagtttgggagagttgggagggcaggaggcctcaggtccctcctggtcttctctgcccggcgctgggttcagggggtcaggaacttacgctgggcggagggtgt

SEQ ID NO: 1388 - DNA, 500 bp, Homo sapiens
tgtctcatattttttatcattatttccctctgcattttggaagatttccttgccattatcttctggtgccttcctatttttctctacagcaatcacatttaaatttctaagaatgcttgcttctttcttgatcgttccttttttctccacagcaccatgtgctggttttatgaacgcaaaaactttctgaagtctccaagatgacattaaccaaagttttaaaagttctcgtctgtttccttgaggatccgctgttgtgtttctcttggtctctgtcattcacgttctgcttttccttatatgtcagatgattaaactccgtctccaacttcactattctaagcagctggtctgttttcaagataatactatctccaaaacagaaatgttggctgggagctctgtgtatgtgggaggcttgctgactggcacctggcattagagtgggaagccagccctagggcagggacccctcaaagccattggaagagagcttaacc

SEQ ID NO: 1389 - DNA, 500 bp, Homo sapiens; identical to SEQ ID NO: 310

SEQ ID NO: 1390 - DNA, 500 bp, Homo sapiens; identical to SEQ ID NO: 316

SEQ ID NO: 1391 - DNA, 500 bp, Homo sapiens
ttcaatgttaacaggaaggagggaagggaaggaggaagaaaatgttaaaagatcgttttttaaggtaaaaatcataactctttactcatataaaatgaatatgtatcaaaggttttatttaactcgttagtttatgatagaacctgtccaatgttacaacccactgaaaggagtattcagagaatcccacaataaagccaataaggaatgctgaaatcaacttacatacagaaataaaactggtctatccgcagggtaaagatagactgcattccattggacataatcatttgtactcccatgggcaagaataatttgcattaatctaagttttcttcaacttacagagttgtaaaatagctcaaagacgatgaaaggcaataacctggaaaagtgtaccggacaaaaaacccagtaatttttttttttcctatttgaaagtctttcataatctttcctaacagaagaaaagaaagaaggaaggaagggagggagggagg

SEQ ID NO: 1392 - DNA, 500 bp, Homo sapiens
tctgtgcccctgcaccccatttaaggggtggggtcggcagatgggcgggatcagtggcgaaggtgggaggaggacatggagagcagcccctccccctcctctgtctggagccggtgctctgcggcggggcgggagggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggtgagtgggtgtggcttggggggaggggagggatgctcgatgcctccctttcccagacccttatgtagaatgaggaatcaaggctgggcaaaagtaatggggtggggctgggggctgataatgaggccagaatctcccatccggctgtgcttttgtccagccgctttgttgctgcctttgtctgggccctgcttgtgggttggg

SEQ ID NO: 1393 - DNA, 500 bp, Homo sapiens; identical to SEQ ID NO: 98

SEQ ID NO: 1394 - DNA, 500 bp, Homo sapiens
cttcccagtctcctaaattaaattgcttagtgcatgtcagcctgtgaggaaggctgtgccatgtagtagaaaggatgagggtttgaaatcatatgtacctgagttcaaatgtgattcaatcccttattagcattgtgtgaccttcaagtcatttgaacagtctatgagcctaagttttctccacttcttacaaacaggcagtgtatgggggttgttagggttaaatgaaacagcatttgtagtgtgtagcgcacagctttgcaagcaataaatgctcaaaatgtgagatgccttctacctctggctttcccctgagatcctgacaaatcctccatggaccaacaaaaatcaaacctgtatgactgtatgcatctgctatggattaaagctgggtcctggatgcctacaaaggcagtgtcctctatgggctcccctggacccatcagctggaccattccctaaggtgtctctgtctgttcctcatttttcacacccatgtg

SEQ ID NO: 1395 - DNA, 500 bp, Homo sapiens
atgggagttcacaaatgttctctgctcttttcactgaagcctctaggggtagaggtgaaagaaaggaaacaaaatttaaaatgctcagggtttgtttttaaaggcaacgactcgctcatgaagagtttgaacatacagggagaccagctgacttgagctgtctacaccttccagctctgttctatttgctgctgtttaatgttttcctgcctccccaaccgggctgcacgccagcggttctcaaaatcacggcaccgcttgtctaacaacaccgaacgctgggcccatccccagacgttccgattcagcgggtccaaggtggggctgggaatttgcatctctaacgagttcccaggtgattgtgatgcccgtgtcaatgtgccggtcagaaaatcacagattgccaactgctgctggatgcaatttggatctccctagacgacttggcccagagttgggcacagagtatgccctcaataagtacttgttggttcactgcc

SEQ ID NO: 1396 - DNA, 500 bp, Homo sapiens
accccccgaagtcgaggacgtgtgggcgaccccccaggcaaggcgagggccgcggggctgtggcgggtgggggcgaagcgggactccccgggttggggggcgctaatgaggagcccgttggagttaactgtgagagtgtgagtgcgagcaccccgatttgtcaggggaccgctgcgggggcggacaggcgggggcctgttattgtttatggtttaccgggcgccaattacacccgaggtgctgtatgggcgggcccccgcaccctttgtggaggctccctctccgcctgctagagcagggcttgggtctccatttgaacccctgaagttgcgggatttgccccaggtagcagcagagcccggcgccttcctcagtagctggtgggaaaaggccaggcttctcaataggttctgtgaaacctgccaagactgctgtggggggcagctccaacttccaaatgattgtacttggatgaacagcccggcgttgttggcgctggc

SEQ ID NO: 1397 - DNA, 500 bp, Homo sapiens
ggctgtcaaagacagccattgttctccctgctctgaacatgtgggtcagccacaagtgctttcagctcccccagcgccaagagctggctgagagcgagagcatgcctggattcttctgaggcatcaggaaaagcgttttgcatatttttcattgcctttctttttttttttttttttttaacttttgcctcagaaagacagctccctttcagagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggttaaggttttggtttttcgtttttgttttgaactatcattgtactgttgtgaatccaaactttgtgatcctttcttctaattctttctctac

SEQ ID NO: 1398 - DNA, 500 bp, Homo sapiens
cccaccccgtcccggtttctcttccaggccagaggcactcgccgctgtcacaacgccactccccggccccccagtgcccctccccctccccgcctgcccgagcggctcccccgtgccccccgtgccagtcccccgtcccccagcgccgctctcccgtgcccccgtgcccctcgccgcagcagcgccgctctccggcctcaccctcctgcccgtcgcccgtcccgcagcgccgctcgccggtgccgccgtcgtgccagtcccccagcccgcagcgccgttccccggtgccccccagctgcccggccccgcagccccggccaccgccgccgcccccgccgggcgagaggacgctggccgagcgcgcctacgccaagccgcccagccaccacgtgaaggccggcttccagggccgccgcagctactctgagctggcggagggcgcggcctacgcgggcgcctccccgccctggctgcaggccgaagcggccactctccccaag

SEQ ID NO: 1399 - DNA, 500 bp, Homo sapiens
cctaacttagataactgccagctagcagacacgactggcctaatggtatttacactgaccaaccctttgtaattttcacttccctggctctaatgagcgcccccccccccccaactcctccctgcttcctcattcttctttccaaatgcccaaattacctctgcacaattggaatggagctcagctctttcccctactgtcaatagttgctgaataaaatctgttttcatcgctttgactgatggtcaacggctatgtttatttttgacagtacctatgttctgccaggcactatgctaagtgttttgcagagattagtttatttaattttcactgcagcacccattagataagcactctactattattatcctcattttgcaaagaaactgacgctcagaaatcctagtgttacttatccaaggtcactcagggtagtaagtagccaagataagatttgagtgtgtttctgactacagcactatttatactattctacc

SEQ ID NO: 1400 - DNA, 500 bp, Homo sapiens
aaggaacaacccttttggggtcattcttgctagggctgtatgaagacagcaggtgcacgcaggctactgtgaagtgcggaaccacttggctggcagcctggaatatagaggggcaatcttctcaatgggttgtcagggctaccacattttggacttgctgccaggagacccaggttcaagtccccactctgctgctatctcacattgtgaccttgagtggtcactaatctctcactagatactgggcctcggtagcctcgtctgttaaaggggatgactcaacttgggtaagtctaaagttttctcagctttaaaacgcagggattccatgtgtcacctctcccaggaatatttgtatctgtggaatgaaagaccttttgctgctgtctcagagaagtatttatgcaggtcaggggtcctttcccaatgcgttggactcatccatctggaggagctcttctaccgaagggcactaccttctcaccaggctgtggcagcag

SEQ ID NO: 1401 - DNA, 500 bp, Homo sapiens
gtttattatgtattaaatttccacatgaatttttgttttccatagagtctttatttcaacctgatgaagtccctttataagattcatctggtagagaccaccagggacacatctgtaggctgacaaaggttaattagcttgctgcagtgaaggagacttgcacagcagaggaaatgtcagcatttctaaagaaggaaccagggttattataggattttggagaatggtggagtttggataaagtttaaacgcaacaatatttgataagcttaaagcacggcaagactgtgtgtcaagggttaataaacatcaggcctgggctgagaagctgactcaggattctgattccctggagactacaaaatcgcgatacatgtggaatgttgtgtctggaaaccccttatctgaagctctgagttgcaaagtgaggttgcttctgtttcataatgatctaccatcagtgcgagagtgggatgttccattctcactttataaaattt

SEQ ID NO: 1402 - DNA, 500 bp, Homo sapiens
cctcctctcatcctgatggtgtaaggatgcggattacaggatgtaattgccataatgcctggtaatggcaggcccagccgcgggtcagtgtcccattagcagccccacgcgggtgctgataagcttgaacatgcatcacacccagcggccagagacgagggcgtcttatcagcgccggccctggggaccgtgtggtctgattgcagagtgacggggcatatgattagggcattgtcgcacgccgtgtgccgggctgagggctgatgagcacaccatcgcgttggagcacagccagaccgcgcacgtgaccagtgtggcctcagcgccaccccaattaggtgccgagagcacggctggctgggaccctggtgggagcagatgggggtcttgcccatcctgctctggggtcccccgtgtgtgggacagcccaccccgtcacaaccggcctagtcctgaattaaagggcctgtgcggctgttctgggcacagccctgtggccg

SEQ ID NO: 1403 - DNA, 500 bp, Homo sapiens
ggcgagggggactttaggtgtgtggaagcctctgcttacctggggcgtgagtgcgtgtgctcagcgctgttctgccggattgccatgtcatgggcctcaccatgtgctcattcctgtgttcattcctttcaggtatttacatagtgtctgttgtatgcacggctctgtgctaggggctcggaggaaataaaaagaaatgaagaatgtggactctgttcaccaggaattcctggcttatctgcggagatacgcatattccagcagttctcgactgagagtgattttttttcccgccaggggacatttggtgacatctggaaacatttgggggttgtgtgtgccgcttctagtgtctgtgggcggagatcgaggatgctgttaaacatcccttaatgcacagcacagcctccccaccctaaagtattatacagcctgagtgtcaggggtgcttgggttaagaaccctggtatgtctcaagggtgtggtccccaaaagccatt

SEQ ID NO: 1404 - DNA, 500 bp, Homo sapiens
ctgtctcagttccagcccagatggagttttgattttagaaaatcattcagtgaaatgtatttcctgtgcctggtagtcattgatcacttaccaaaaaaaaagggggtagtgggagactaaaaataaacttatgataattcacatacacttaacctttactgactaataccaaaaagggaatgaagcaggctctgctgaccagcacttgcagatggattccaggaacgtggctagagctgccaaagccatcgctgaatcctgccaaaagcatcccaggggattttactaagggtggggagagcagggaacatggaggtgtgtgtgtgaatttgttttaaaactctcttactcaacactgagcagtgggaagaacactgggaaaaaaggtcggaaagtgacattctagactgggttccacccaatctctatgacactggaaaagtaatgtgtcctctttggaacttcaggtatcatgtgaacaataagggtgtcatattaag

SEQ ID NO: 1405 - DNA, 500 bp, Homo sapiens
ggcccatgcaccaggaccctggccttgttcctctccactcagaccccctccctacccagccagctccctgccttgctgatgaaggtctggcaacagctcttctagtcacccttctttctccccttttggcggggaacctgcgggggtggaggttctctccttcccctccttggctctttgtgtgatttttccatggaaactggttctggggggaaaggaggaggtgattaggacacttggaattctgagcggtaccaaatatctataattaaatgtcttgtcacccagcaggagggggtgagatgagggaggacaggcagaagggcagcccctttcctctgtttattcctcacatctcctcccaactccttcctaagggcctgggctcttggggggaacactgtccaggaatgagtcctccccagcgaggaagggttgggggatggactagagttgagtctgacattttccagccccacgtttctgggaccagctgggtt

SEQ ID NO: 1406 - DNA, 500 bp, Homo sapiens
ggtacacctaactgaaaggactctaagaacccatgcctctttcatagggactgcagctcaggactttgaagtgacttgcaaaggccacaccgccaggaccagagcctgcttctccatcccttcctcctgacacagccgctgataaatgccattacctgaattccatgctgagttgctattcttatcccacggaggctgcctgtgtgccattgttttaattacaggctgttatttcatttgaaaagtcagcgataggattaagggtactgtcattttaaaagccagattcctggcctaaaaccgctcagtgaatcagaggacaaatgttcccattgtgctggttaaaaataggagcaatggaaaaagtgacagaatgcgatgaataccattaaagtgtaattacatttactgtagatgtgagcctcaggaagagtctatcccaggcagggaagcttggtcagagcctgtgacatgaaaaacccaaagcctccgtggacggc

SEQ ID NO: 1407 - DNA, 500 bp, Homo sapiens
agagcggagaggcggagaggggcccacccaagtcaaggagctgactcgcgcctcccccacgccgcgccctcgctggctcagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggtgagtggagtggaccaccttgggcccggggctggggggagatggagggaggggcctgggcctcagtgtcctccagggtcctctgcctgggggcctcctgctgcctcctggctgcccca

SEQ ID NO: 1408 - DNA, 500 bp, Homo sapiens
attccagcctgggcaacagagcgagactccgtctcaaaaaaaaaaaaaaaatgctcccacctcagacagacccccaacccccacctcagtagctgggacaacaggctcataccaccatgcctaatttttaaatttgttgtagagatgggttctcactatgttacctaggctggtgaactgggctcaagcgatccccctcctctgcctcccaaagtgctgggattccaggcatgagccactgcgcctggccgatgtcatatctttaggagcgcttccctgaccactctgtttaaatagcatcccccgcccttcccttgttttctctgatcattctctgctatattttccttcacagcctgtcactccagaaaggattagtttttctgtttcttgcttccttgctagagaatgaatttcatgagggactttgtctgtgttattcatgttcccttagtatctcaggtagtgcctggcacatgatagacatgtaataaaaatta

SEQ ID NO: 1409 - DNA, 500 bp, Homo sapiens
ttttaggatgcagttgtttcaggctaaaaataaatcatgcaatgaataaaaaagttagatacgacactgtagagggattcgctgatacagtctgtccgactggtgaagagggaagaggcagaaggaaaaagacaagaatgtacacgcatgaaataaggaggctagaaaggtcaaagaagagaaagaaactcgagagggagagagataagggactatggtgccaataagcaaatggagagttcaaacatacggaatgacactcatacattactgaattgttaaatcaccccagggtggtaactcagcctgtcccctcacggtggttgttcatcctctgttcctcactgcaacatggaacaaaatggagccccgaggtagacttcttcatgttctactcctgtctttttctgccttccctcctctcttcttaaaaatcctctgccagccactgggcgaggggtgcagggacaccctgctgaacccagctgacaccagaagaa

SEQ ID NO: 1410 - DNA, 500 bp, Homo sapiens
agcgcatgcgtagagcggagaggcggagaggggcccacccaagtcaaggagctgactcgcgcctcccccacgccgcgccctcgctggctcagatctcgcacctgcagcagagccggctcccggagcagcgccaccgccgccgcccccactgcccggcctcccctccccgcaggaagccccgccctctgcgcccccacaggccccgcctctccctggcagcccggagcccccgcctgcgccgccgctgcccggagacctgccgcccccacccccgccaccgccaccacctccgggcactgacgggccggtgcctccgccgccgccgccgccgccgccgcctcccggaggtcctcctgatgccctaggaagacgcgactcagaattgggcccaggtgagtggagtggaccaccttgggcccggggctggggggagatggagggaggggcctgggcctcagtgtcctccagggtcctctgcctgggggcctcctgctgcctcc

SEQ ID NO: 1411 - DNA, 500 bp, Homo sapiens
cactgtgccattttcctcaggtctgtagacatgcctcttcttataccccacaaaatcccctccagtttcctcctaatattatctataaagcagaagaaaatagcctgatctgtagagtgaagggggattaggctctaacgtcagtgtattagccctactgctgaaaattcctgaaattcttaatcgattacaatagtgttccatacttaaatacagcacagcaagcttttctccagcattgtgttggatcgctgtttctttggttgaacacagatgatgttgggttatatttaggggccacatagtttgaaaataattcatgagtgtttaaaagactagcatattcagcatggtaagatgcactcgtgaggagatgggaccctttgtacttcctagagtacaaagaaacactgacctagagaaccatattctaagaagtctacttttgtttaagcatttttctgggtcagctccagtaaatgaatcttgctattcataat

SEQ ID NO: 1412 - DNA, 500 bp, Homo sapiens
acattatttcaaacttagttatcaacatcttataaatttttactaatattttgagtctaatgaatcagtctctttacttaccttaaaaagcagaaaaatatacacaaaatactataatggttacaaaacttatttctagataaaatttatgactagacataacttagcttgtcttccaagggtctttgaaagtatgtttgttttctggcaataagaagatatttccagactcatcttgatatttcctgccgtaaaacatgcaatgaatttttctccagggagcccagtgccctcagggtcttctggctggaatgcagattagatggattggcaaagcagctgctggggccacaaggggaaaccagaaatccacagtaatctttgacctgacgtccttgagctgctgaaccaacatcccaggtttttaagtccctgtggtccatttgtcaaatgcaattccttactgatataatggttatacaaataaagaagcccagaga

SEQ ID NO: 1413 - DNA, 500 bp, Homo sapiens
ggaaagtggatggatgagtaataagtgacttagcaaacccaagactgctggagtctgagtgctcatgatgggaagcctcaggagttggaggaacaggtgggggtaaacatagcagaagacccttggcctctacagctactccagctggagaaggaaagtttattttctggagaaacttaacaaagacacaccaggctctgggacatcagacacagcagagggtggggttaggcatggagctggaaatagcgagattagagaaagactccatactgaaagatgagattccccagcccattttactggctcagctcccagaacacaaacagcctagctctacccctctccacccaccctaccccagcttacactaagcagaagaattaaggattcttccctgtagaaaggactcaaccaaagagacaaacactacagacattgatgtgtggttcctccaatgaaaccgccaggggccttctggattatcctacagtgaagtc

SEQ ID NO: 1414 - DNA, 500 bp, Homo sapiens
caaaagcaacaaggagaaagggaaacaaaaatgcaaacttcattttcagcagaagtagaagacagctaaacccccccagagcccaaaataggtgtaagggctgccaaaagcagtggagactaagcagaggagagcaagactcatgtgggaggaagcccagagaacatgccacagagtgaattccatagcagcaggcagagggccagcttctgagataggagagagcgagcaaaattcagctctgcgaagcgaggggcccagtctgttgttagatctagatcttcctttgcaatgcaggattggggcacttgtgttggccccagaagcaaccctggacctgagttgatttttagacaaagaagaaggaaatctaaataaggaatcacacacacaccagcatatatacaaggaagcacatggttcaggatagtctctgcactgtcttgcatctacctacacccagctggctggagagaagtagtagctacataaaccaatgt

SEQ ID NO: 1415 - DNA, 500 bp, Homo sapiens
cagactatttctcggaagaaaaagaaatatacatttgtggggccaccagttttttatgtaagagctttgtggcaggcagacactcaactagttggatttctttccattgtagaccatctaaaatgcatacaaaccccctttgaggaagctgatttttgagctcaaacgatatcctcaagggtcctattatcattagattacacttactgagaatgcatagcataacaaagtcaggcactgggctaagtgcgctcacatccattatctaatcatcctaagagcactgatatggttagtatcattccactttaattatgaaacaagcgaggctcattgaagttaagtaacttgtcccaggtcataaaatcgcagataatgtgctgggacttaaattcggtactgcctgatgccaaagtctaaaccctttaacgctatgccaacatttctcaaactttaacatgtacacatgtcaactggggatctcattaaaatgcagattc

SEQ ID NO: 1416 - DNA, 500 bp, Homo sapiens
ggcaccgcccctggagaggtggcgggtcagaattgtgacttcttcatgccggggagggcaatctgtatgtctctggggaggagtagtgatgatggggactgatgcggtgtgaaaacgagacagtgagatttgacagcggaaagcaaaatgcacagggacaacgggcaagactgacaaggagtgcaccctgggcctcatcagcgtcccggggtcccctgaaagactggctacaactccgaccggacaactcgggcgagctcacttccacacaaacttcagactcaatatggcaaaacataatcagacaggaccagcagccaactgcccggacggagctcccccacaccaccctcgggattccgcccctaacaaaccccgcgtttgcatccagatgcctctgtccctagatacggtgtgagaactccatttcagagctggaatttgctccccagattaaatcctgccactgataggccctgtgccatctgagagcgggaggc

SEQ ID NO: 1417 - DNA, 500 bp, Homo sapiens
gcccagaaaactggtagactggtgggcaagccacgggtcaggcagctaaacgggaagctgggaagcagccatgacatgcagtgccctgttggccacctgctggccgtgggtgtgacttagggccagtgctttctcagcaggcatctgctgttgtcgtcgtgtatatattgatatctgtacatttccaaacttgagtgaagcaacgcgtctgcaggttgcatcggtctgctctgctgcttctctagcagtcgacaccatttgctcttatgagcaaagtgtcaaatgagtgttttatcatgagagctgtcagtgtgctctggcgacctcaccctaatgatgttctgattctgaggcagcaggcgtgtttgcagaatgaaacccggaactaaaagtgtctactgttgatcgatgccttgtttcaagcactgctgggcagccccctacctcacataccaaaagaaaggataagaaacctggtttcccgtctccttcgatgtagt

SEQ ID NO: 1418 - DNA, 500 bp, Homo sapiens; identical to SEQ ID NO: 517

SEQ ID NO: 1419 - DNA, 500 bp, Homo sapiens
ctgatgccaacatttatatcagtggatacagaaaatacacagcctgattattttttattactcgtacccataaaattaaagatcttaaacatgggatggagggtgcatccgcatcaagattttgttagcatgagaccgaacccattcagccacggccttcatcagaagccttttgagtgatgagacagtgatgagatagctcgcgttatcctgcagcacagagctgcgcctggtcacggcagggtgcaccggctctcgggcttcagacaacagcttatcagtaccttgcccgtgtgcaaggacagtactccttgatgccctgaaacctccgctcctactaactgtccttggacacgtcggcatacagagaatcaatcgtactctcagcagtggtttctgcagcaactctgggtcatggaagaagccaagtgcattgttgaaacagcagagcccaggcagtgccccgatagaaaccaggtattgagtgcttgcacccgttc

SEQ ID NO: 1420 - DNA, 500 bp, Homo sapiens
agccaccgtgcccagccctcagtttagcttctgctgctaaacagtccacccttgggagagagactgaaaagggtggggcgagggcccatctcacttgagaaagtgcaagcctgacagctgaagggtcccagagcagcaaatatcaccttgtttctatgggaccattccagctgtctgcttttgattgacagaggcatctggctgctaaaaataccctcctgaccaaatgttccctactccaactaaagccgaacaggattgttgcagttcagaacttagcacatacagatagcttctgcttgcaatggaacctctcaaaacttttcaggccctatgccatattaacccatggtcattttctgttctgtcggctttgctgggtgatgaatgaaactcttcccagttcacttgttctcttgtctgtcccatccccacctccaggaaaagtagcagagggggaggtgagggcccagtagctgagagcgagtagggaaggggag

SEQ ID NO: 1421 - DNA, 500 bp, Homo sapiens
actctgtcatgattgcttttaaccttgggaaagctaagttacccctctctaaatctccagtcattttcttattggtaaaaggagagataataaggttatttgcactacagacagagatgaagagaggattatgaaatagtgcatgtagtgagattagcttaatgcctggtccaaagaatgtagacactaaacattagctgttggtattattactaacagagagatgaaaatgacaccttgtaatcattccgtgacctcagcgacattgatgttacatctacagtgcactaagcactgggaatgcaaacgtgataagatccttgaagtctagtgaagaaggaaagcaaggagagagtaacagctgtgtgtgaagtgctgtaacagagctatgcacaaccgtctacaggaacaggaaggaaggatttctagaaaaggcctttgggaaaatgtccaggaaatatttatagaaacctgaagtcatcacattgatttacctaaat

SEQ ID NO: 1422 - DNA, 500 bp, Homo sapiens
ctttcaccagaattgtggcctgagtggtggaaggctaaggttaaatataggtatatttgtgaagacggcagatagtggatgtccgctggctgagatggtgatctattctgagatctgggtagtatattctaaacagaacatagcaaaggatcactttctctgtgtctgaatcacagacacagacctcagagctggctgcctcgggagtgccttgctgacggtcgctggagttcgtccatcaggcgactgcggtggggcacggagagcaaccgctgcctggcggagactttgatgtgcggctgaggcctggcgaggaattttatcgtcaggcatcagctgagataggaacgctgtcagtcgagaattttcacattctagaatacgcattcaccccagagtattgactgcaaaccaatgcagcttccacctttggctcaacacaacttaatttctgagatgagtatgattcataggtgtttttgtatttgaaaataaagatg

SEQ ID NO: 1423 - DNA, 500 bp, Homo sapiens
gcagtctcctacaggtgcactcactgcacgcatgctgcagtgcctgccttagtgctggactgactcggtgctggaccgacacggtcctgaccctcctgccgagccttctggtgtcctggctggtgcccagacctcggggtgttatctgcaagctccccttaccatacacggcaaacacatccttgatctccttctcgatcacccgcagcgcggcctcaatgccatacgtgttggctatggcgtggatgtcgttggagtagaggcggcgcagatccaggacctggagagaggaaggaagggatttatttagagggcctggccttctgctcccttctgcctgcgtatctccccctggccgctctctctctccttgtgtctggcagctcggtacagctgatgacaaagtggtcaagaggtggcccaggattagcagaaggaaatggctaggcagagctgctgacggctcgctggccggggcccaaggtctgtatcgtcattac

SEQ ID NO: 1424 - DNA, 500 bp, Homo sapiens
gcaaggcctttcatcagtgttttggccttctcattgggtgaggaagacattgaaccaacagccaacgagatatgaacctgtaagaaaaaagtcctagaatatagtatttttccccaggccagcaaagtgaagaaatacagtggtgacagatgagaaaggccatgttcaagagatctgaaaagtacattcctgccttatcagaaaatgtgtcagacaggttttatgtcagcctcagtgctcctgcggtgtcgacgctctgataaggaccatgttccagttagaatgcgagggagggaaagagctgcactttgcttcaccatcagaactctgagccaaataatgaatatgtaaactattttatgattattttaaatgtttgtttggtaacatttataagatctatttttatttggggatagactgagaagccaccatttacatattaacaagtgacttcagttctaagggttgagatgcctgtgtggatttataaaatggtt

SEQ ID NO: 1425 - DNA, 500 bp, Homo sapiens
actgcaccccgcctggtcaccagaacacggggctgtccccatcctcgcgcacgcggtagtactcgtggccttcgggcacggccttggctaggccaaagtccccgatcttgaccagcctgtcgttgtccagcagcacgttgcgcgcggctaggtctcggtggatgtagtgctgcgcgtgcagataggccatgccctggggacggggcagggctcgtgagtttcagtggggcggggttcggccgggggcggcggcaggacctgagcagccaggagggctgggggacagtcaggtcaggccggtggctacccggccgctggagagggccggatggcacgtggcaccaagcaaaaggaggctgagccagaaagcagggacggggctagacgagcaaagctgggcaggagggcgagttgggaggggccgagccggctgtgcgtggtcccttgggaggagggggtgtggccaagcaagccaaacagttcggaggtcagtgcaagga

SEQ ID NO: 1426 - DNA, 500 bp, Homo sapiens
aaataaagctactttaaaaagcccatttatatttgaaaccccaacaggcttctcaaaactgctgtcattcctaaatacgaagtcttaaaaaatccacatgtcctcctcagccagaggcctatggacagcacaaaatacaggggaatgtcgtggtggcggctgcctcgaggctcagcagctgcgtgcaggatggagctccaagcagggcaagctgccaggcagtgtcaccaccaggcccctcgactgggccgctgtggtgacatttacagaaaactctacatgcttagggtacagtcagaattaaacactctgcatgcaaacgcttctctgagttaagcactctgcatgcaaacgcttctctgagtgactttacagtctacaccttacaaaattatacaacatacagtcacgcactgcttaatgacagagacgggttctgggaaacaacacatcattaggcgaccttgtcattgtgctgtccgagtgcacgcacacacttc

SEQ ID NO: 1427 - DNA, 500 bp, Homo sapiens
tgtgcctggctgcagggagcacacccacagcgctgtctccatgcctcttggtctccgtgcgccgtagacagacctgtccaatggcccatcagagcctggaactgccggggcagcccgacccgatccgcgagggacactgaggctgattgtccggttgcctccagagaagatgagcctgggcggagaccggcctcactgacatgcccccgccctggcctcaggcctgccctgctgaggcccgataaggcccggcccaggtccgcctcaggctgcagcattatctttaacgactgtcacccagacctccagaagtggcttttatatatatagaaaaatataggactcgaacaatgaacttttcaaagcgggaggctatttttagagctttgctgactgatccaacattgagcatctccctatgtgtcagcagctgctggagagatgggcagacggcacgaggagtcgggcagcagtcagcgtacagggggcttctcaggcca

SEQ ID NO: 1428 - DNA, 500 bp, Homo sapiens
gggcaattaccccatcatgcccagcaaacgggaaaatgagcctttggcttgactcatgtatttaactgttgtttcaggagaggcccaaaaggaaaagtggttacgtcaattgtattttaaaagagtgactaagttgtgagcatttccaaaaacatatttttcttcagagtttagttttactatctttggagacaatgactcaggcatctctttgttgcctgctctctaattagcaagttctaaagacatcgcactcagaaaagaggaaaagtagccttgattttgttcaaaacttcactcatatcgtcccctaaatgaacttctaaaaatgctatcaagctactacagaagctgatgaaaggagaaagtacaccgcctgttacaacaagcttccctagaagcacaagcccagccctctgacacaggctttcaaaggttgccaaggtcttcagacacacgttttatcagacacctatttactctgtgaccctctagagtgc

SEQ ID NO: 1429 - DNA, 500 bp, Homo sapiens
ctctagatcagataggcatacgggcctgtcaggtagtgtaaatgagttaagtgggccagtgtgagtgtaaaacaactagactcacagggactgtagtcaactaaagaacataagccctgcctaaagatattccaaaagatattttaaatcagtgtgaaagtccaggcaagtctactgactaaatacagcaacaaatgatcaattttgatctcttgttggatagcacactcaacgttaaagagtagacaccggtcgtgatagggaacactttcctcccagtgggtaacaggtctgatagtggcttgctttggaaatgccagaaattcctgacatatctttcaagaaagataatgtgataaatgatatgccattagctttttaaataataaagcagcctgggattatatatccaaccattccattttatttcctttaataaacaaaaacacaaaagaaaaatgtaagcaaaacaaaacactttcgtggtctaaaatctccta

SEQ ID NO: 1430 - DNA, 500 bp, Homo sapiens
ttcctcatcatttgcttcctacccttaggcacaagtgaagtcctgtcagttttacctctctaatgtatcacaaatgtttgaatcctctctttccgaatcccccttcaccatccaagtttaggtctttatgttacatctcactgaaaatattgcagggatctcccagcttgtgctgcttctcgctcctacttcattttacatgttgctgccagcttaaattatcttaagagataattttgcttgtattgtcggtgacactttgcctgtctgccagagtaaggacagattcctctaattttaaagatagtgtagctttgccttcatctgtccatttctttcaccctttaaacatttattaaacacctactgtatgccaggcactgtgttaggtcagaatgcaaaacattaaataaaaacaggttcctagctatactcaaaaaatagtctttctagggttggatgagcatgaaaacaattattgaagtgcaatctgagaagtg

SEQ ID NO: 1431 - DNA, 500 bp, Homo sapiens
ttgtaggaactgctgattagccacatactggtgaaatgaggggcctcaaatcagtgcagagagaagcctatcagtgcttccctgaccatgggactgtgagtggaacctttctcactagaacagaaggcaggaaggacaagcactttgatgtcaatgctgagcataatttgcaggaacagtaagaagaaactcagccaactgagttgaggaaagaaaaaaagcacagctgaggtgttgaaaatgtgaatccgtactggataagggataatagaaatagcctctgtccaacaacctttcaacaattagaatgtgatagatagacaaggctatgaaacaactaactacatacataactctcacagctgggttaaccctaaaggaatctgtgagatttgaaacatgactactaaggcactgataagaactcttcaccagatgggagcctgtgaggaaaacacaatgtttagcatattaatgaaaacttatatacttggccaatt

SEQ ID NO: 1432 - DNA, 500 bp, Homo sapiens
gcctcccaaagtgctggaattacaggcgtgacccaccgcacccagcccaaaattggcatattctttttgaacgttttccctttgggagaggaacaagagcattccttacctgcttgggagaaagacttaggaacaagaattgaaagtctgcttacctgaggtttaattttcgatcttcttcgctgccagcctccaactacagagaaagaaagagaatatcacaccacaggcaccactgtcaacacgcctcgggcggcagtctcacattttctaccccggtactggaaaaagataaagatatccaggaaacctagctacttctaaacagccgtgccctttcctcaccaatcccggtctgtcccttggagtcatttccgtgggggaattttcaggtttccaaatgttgacccacattcctgccgcagtccaggggatggagtcctgttagctcaacatttcctatctggtgttgttacccagcacggtcttttagccctcag

SEQ ID NO: 1433 - DNA, 500 bp, Homo sapiens
gctcctggaagcggcggcggcagtcagagactgcaaagaagtcctcacggtcagtggagacaagcagcaggcagaggtcagtgtcaggctctaggtaagagatgtgtgcgtggaagaagccggctgcgttgaatttgggcaggcacacgggcgtccaggcctcgccctcgcgaaaggacgaggaggaactaatgaggttgaagagcaggtgcaggtcgatggggtgcagaaattggtcctttcggcgcacgagtgccacgagctggttgcgggccagcaggatggagaagaccaggctgcgcgcacgcgcctgctgcaggctggcgctcacagtgtcgcgcacggccgccgccaggggcaggcaccgtgccgcccccatcaggaagctggggtctcgtgccatgagctgcagcaggttgtcggtgatgcgctctgagcccgagagtaggcgccgcaaatcatagttctgcttctgctggaagatgtggctcagctgcgca

SEQ ID NO: 1434 - DNA, 500 bp, Homo sapiens
cttgttttcccttcttctctcccacaacgtgctgtaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggtaggtagtgcacaactgttccccggcaagatattgatgatatttgttgtgttttgtggccaggcagaatgttctgtgccttatgtgaacgtcactgtgaagagcgtcatggagcacatggcccttttccttggggacatttttggcaggtgccttggcaaaccgaatggaattacttgtcagcttttgttttcatattcacatgtgacatcttttctttttctgttccctgtctcaacctgtgtttgctaatagccttgttattatttagagc

SEQ ID NO: 1435 - DNA, 500 bp, Homo sapiens
agcaagctagaggagaagaaggaaaaccctgaatcgttataactacaccccagatgcaacgcaagcaacgacttcgtcacactaaaacggattttgtgagggccaaaagtataaattacgaagcagaaatgattatcaaacaacttccagcggtttgcacctaaagaaacacaaggagaacccactacaaacaaacaaacccagtccaaacaacgcctccagtaggaaaagaggaaaactgcgataacacgaccccccgagaagagacgagaccaacacgctgagactgtggggcgtcagcaaacctccaagtgcacggcggactgagttgtacttcgcagctctctggacattaattacctcctgcaccttccatttgggggagggtgaggaagaaggcactcacctacactgagcgaagaagtcctatcagcgtggaagagaagtttaagaatgaaccactgaatgtttcgcttttatttttaaatttactttggcac

SEQ ID NO: 1436 - DNA, 500 bp, Homo sapiens
tttttttttttttttaaacattctctgttagcaatcacttttaaaagactagaaaatcatttttggttttccaaaccacctccacccagtgagtcagttagtaaaagggctgggtctcaccgtttctcattgatggcatgaagcccaggaacccaagaggcagctgttgcaaatttatgggggaaaaaatacacgaaacaggaagggtgactgaagatacgcgcaacagcgaatacaattttgcaaaaccggcttctaggtatggtaggatcatttaaatccgtcagtgatgtggagaaagaacatggaggcatggctagtcctctgcacggacaggtaggtagccaaccaccagtgaggactgaaagacagtcctcactgaaaaggactgaaagtttgcagtggccaaaattatctcttttacctattcagtgcttgaaactctttccttgcctggaaggtaactcattacactcatcatctaattcggacacatttag

SEQ ID NO: 1437 - DNA, 500 bp, Homo sapiens
aattaataaagaaattatgtttatcattatttctacttcacatttttttctacttcccctttgctttgcttacttacaccttcaaaagaaaaaaaaaaactcctgtgcaatgatgttttatcattattgtcattttatagatgagaaaggtaaaatcaaattatttaatttagctaaaatctcacaaaagttctctcaagagaacaaggaatcaggtcttactacataagggctttctctatggtgacacgtcacatctcaaaacaaaacagaaagtaagacaaaccaagctgtgatgcaggaaaacagagggaactggaagttggataaagggcagaatgagtaaaagcagagagcagaagcaaggtgaatgggtagctgagtaagaaacaagagacagaagctgagcagccaaaacaaaaacaagattaaaaagtgagtaaagagaccccatagctggctcctcagagatgggcatgcgcatcagagagaaaaagtat

SEQ ID NO: 1438 - DNA, 500 bp, Homo sapiens
actggcagcacgagaaataaatacacaggaaaatacaatatagcacaaaccaggagctgagggcgaatgaagatgctcagaaacacctgcactaaaagtttcctgaaaaaggtaaaaaatgtcaatcagcactgcctctggaaaccagaaacattatattatttgataacagatcctaagtctggatgctggaggtgcttaaaaatgtgcattgcgtctggctttctttccatgtatacatttatttgacgctgtagtaaaatctcctccttcaggtacccatattcatgcaagcaaatgttagcaaactgccacagtagcattttaattagtgcacaactttctctcttcaccacattataatcttttctcattttgttctgctgctatttctattatgataaaagacttaagtaaatatgtagaaatacttatatacatggacacgcaataatgattcaaatagataaacacagaaacacaaacactaagggaggtac

SEQ ID NO: 1439 - DNA, 500 bp, Homo sapiens
aaaacagggactttccaggatttgccaacaaatctaatcaaaggaaatctctttctctctctctcaaaaaaaaaaaaaaatcatccttaagagagacaaacctctgaaaaatcagtttatctcctgaatttttgaatacatgggctcttcttaactgacctgtttaaatatccacagtctttacagatagttaaaagacaattctcatctattgctttcacatctttaggtaggtaattttcctttttacgtttttttttttttaatgatcagacatctgtttcaaatgaggcaattaactactctttaaaatgccacttctgtatttaattcaagagacatcaacagaaattcagcgactagctccctcaaactggattctactttcttttccatttctttttaattgaaaacatctggaattttaaacatgtaagcctttaaattatattccaaagaaagccatgtttcagtctcaacttagatgcttagatgctcaa

SEQ ID NO: 1440 - DNA, 500 bp, Homo sapiens
gaggcaaaaccccgggccacatggacgctgaagttggatggcaaccttcagctagactgcctggctcaagggtggaagcaataccaacagagagcatttggctggtgagtgtgggtttcccaggcaatagctcttctgagaagagaggctcaggctcagcttagcatgatttattcctctgagagcttgttgaaggagtaaatgtcaccagggcctccatcctattgtggtcatagtactctttagggtcgacatgataagacgactccaaacctccattttgtttaactgctggaagtttcttcttttactaggtttccctccgtaaatatttctggaaaaccctggagaaggctccctattccataaattttcccttctagtttctcaccacgtcatttgttccagactacctctagagtcttttgcagtctccccagcagtcctgaccagcttcccccagctgcaccagctctccaagccttggcactgttcagtac

SEQ ID NO: 1441 - DNA, 500 bp, Homo sapiens
cagtcagtttgcaggggtggggggaggggtttcctgcccattgtttttgtaatctctgaggagaagcagcagcaaacatttgctagtcagacaagtgacagggaatggattccaaacaccagtgtgtaaagctaaatgatggccacttcatgcctgtattgggatttggcacctatgcacctccagaggtaagaataattccttttagttttcggatttcaaaagaataaacctagtagaagtgaaacccgtattgggttgtaaggttcgtgttcctaccttactctggatgactcactggtctaggtttcctaggctaggagaaaaaagtaggcaatccttgttctgcattgaggtccattcctatggtcacgtactgcttatttttcgtttgtgcactgtttctttcttctgttcatgtctagttcccagcttggcagaatatgtaaaactcagtattgaagaacactgttggtcatctccctctggtggagattaat

SEQ ID NO: 1442 - DNA, 500 bp, Homo sapiens; identical to SEQ ID NO: 1001

SEQ ID NO: 1443 - DNA, 500 bp, Homo sapiens
taccttttccaccatgccacactgccttccacccaacgcgtgaaaactttggcctgaaaatcgggtgatgtgactgtaagaaatgcacccattattcccaaaggagtcagggaaggtgatggcccttagccagacaagaaaatatattcttggaagacaaaaaaagtgtcagaagatttattagtctttgtgttgatattcactgagcaaagaaagaaaaaacaaggaagtcaacagtaaggaaggaaacgatgttattattgaactgattcttaccttgtgtatgttagttttggatcattaagccactttgttactgcactggcttcctgaaaagccaaaaaagtgacattcacaagtcatgcttcgttgtactagcaaaggaaggacatgctgtaacctcacgtctggcgtcccggcactttgggaatgtcaacatttatcagccttgttcacatctagtcctcctccaacaaagtaagcaattgtcccctgaactc

SEQ ID NO: 1444 - DNA, 500 bp, Homo sapiens
gggccctcatcacttgtttctgggcaggcctttggattcataaggctctttgaatgtttcaagaaacaggcaaatgtccactccctagacaggaaagcactttgaaacagaagacacctttgtttgtctccccttctcatccacagatgagtgggtgcagaaaggggctgtgcacccttggtgagctcagacaagtcctcttctctggcctccgttatgtcgtctcaaacacgcaggaggaagtttggacgacgtgcaggggtgaaaacatttcttttctttccctgtttaggttcttagttgacacgctcccctggaaacaaaagtcaacttaacaaaagaaaaatcagccaaagttgattaacacatgctgtacccattatgcagtagaggcctcagttgagaagtatttctctctcaaggcagtggcttaggggccttgcttaaatagtattttaacaaagagccgtaagtcccatagagtgacaggacagagaaga

SEQ ID NO: 1445 - DNA, 500 bp, Homo sapiens
aacaccatgattttatctgacctgtgtctcacatcaggctcagctgcagcctaatttggtcctggtcatttttaagaaaatgaactgacttataaattccttcccatccttgccacaacgttataggctccacgtccctgagctgaggtacttcagagctggagaggaagcaataggagttcttacctgtgcttttatcttcagtccaggtaaagttgtttctgtcacttctcttttctttcgctggatcgctggacttttatttcaccccttcagtgttgtgtagctttctggattttcctcagtgatcaaataattagaagttaagcaacctttgtaatggcttcagagcctaatgaaactgaaagtacttctttcaaggaagtgactcagtaaccataaatgcaatttctggattctgctagtaggagggtttaaagtcaagtttcaaagtttttttgttggaagagatcttagagaccatttattgttttaaaaac

SEQ ID NO: 1446 - DNA, 500 bp, Homo sapiens
ccagcaaagacttaaaagttaccgaagaaggtgttcatgctttcattttatcttttttttttaacctagcaactgatgacactgcatatcttcccctgttcttattgggagaaggccttgtgtgtcaccaagaggttctcagaagggacctgtcagtttttggttaaaagaacccggaaagagaaggactatgggggaactgatggcgttcctgttacctctcatcattgtgttaatggtgaagcacagcgattcccgtgagtatcccacgtcctcttctctcctaactccaaagtcgaggcagcctagaaggcacagcttttcttcctaaaacttgtggtgaaaaatatagaagccaggggcagaaacgtgtatgtattacactcagactccaggagcaatggattgcctgaacagtttcccagttcatatttgtaggattttgatgtcaccaccttctgagggagggggagccgttctagaaagactctggaacttcc

SEQ ID NO: 1447 - DNA, 500 bp, Homo sapiens
cggacagaaaacagtcacgcaattttgtgaagttgcagcaacatttaacgcttgggatatttcaccataaaagtctccatttctggcttcatttgaacagattcagcagcctgggaggtgtggcccgtgcaccgcctgcctacttagaattacattcccagctcacagccgggatggcaggagagtgcggaagcggcacatggcagacacaaccggggatgacccagctcctcaccagagggcaggtaccggaaaccagcaaacacgatttgacaggacgcagagcaaacaccgcattaaacagctcctgcgttccaaggccaggtgcttagttcatctatggaaaccttacttaaaacgacacaattagctcaaacggactcatcctaccttagattctactcgccgcgaatggatgcatgcagcctgccatcaagccacggaggtaccacatttctcaaaagcaaaagctaaccgtttttccatcgggctcttttctt

SEQ ID NO: 1448 - DNA, 500 bp, Homo sapiens; identical to SEQ ID NO: 486

SEQ ID NO: 1449 - DNA, 500 bp, Homo sapiens; identical to SEQ ID NO: 491

SEQ ID NO: 1450 - DNA, 500 bp, Homo sapiens
aagcattacatacagcatcaaaattactaattcagataaatgataaaactttatactggtttactaagaaattccaatcattacaaagctgtaagtaaacgcattagaaaaacaagctagtggtcactctcagtacagtgcctgatggtatctgtctaaccaatcctttttcacaggacaactattggaagacacccacagccactaaggatttaggcatttcaaagcatccttaatacataaaaatatcgagaaaaaggctttgatataataccaacactacacataggaaaaccactacccccaaacatcagataaaaccctgagatttttagtagtaacagtagtagtttaacaggttgaacccaagcactgatgatgcccattctgctgcaaacaaagataatttcccagggattctcgattcataaatgatccactctcgacaggatcctccacaactggagacaacatctaaaagcccatattcaagtgcatac

SEQ ID NO: 1451 - DNA, 500 bp, Homo sapiens
tccctctctctccctttggcagagagccctcggaaacaggagttattgagaaaccaaaagtaaacagctcagcctctccccggggcctgtggagcctgttgccccggatggatggggttagtgccagcagctgctcagatgatctgtggggcatgttctggggtggagggggctgggagccacggggcagaatttggccgtgagagaagcattgcaaaggtcatcgtaggcctgacttctagggcacatcgtcagatcgaggtcggagaaaaggcaaaactgcaagccccttcctcatgcttgcttcacagccacgccgcttggagttgaaagcagccagaataaccgtttcctttgagttaacaacgcaggtgccgtcatcctcctgtgagccgcggctgctcagggaccacaggggagggagcgcggggcctctgaatcgggcatcactttctgctctgccccatgggcccctcacacacagcacctactagggacag

SEQ ID NO: 1452 - DNA, 500 bp, Homo sapiens
gagtctgacattagaaagccagcgagaaggaagattcaaacaaccaaccctgatttcctgcttctccttttcatgagtgttcctgtggtctctgcacctcctttctgtaagtaccgatcctgcaagcatcacagcttacccagacgtctactaccttgtaagacaattttgttttcttctcagatatttcatgttctggcaatccacataggggaactcactggttgttcagtatctgtgaccctccctcgctcatgtctgtataatctacataatctaccccctttactctctgctctccttccttccactcttcggcatcaacatgtgtagctctggcctcaaagatgatgaaagtaaggccagtataactggttagaaacgatgcagggctgactgcacacagcagagtcttgcacgcagtgtgtacaaggacatggctgtggcttgtgcaatacactgttcatcagaaataggtaaacaaaagcaggtcaccgacc

SEQ ID NO: 1453 - DNA, 500 bp, Homo sapiens
acaaagacatacaaaatgctttagcaagaagatctaaaactttccagaatttcagtgctttgtttccccctagcaattaagttcaatcaggcatgtgactgaccacacacattttatcagagggttaaagaacacattcagccatgttcttcaacaggtaagaaccaccctctgtttatcagctcaagaaaaagccagaagcaaacatacaaaattgtaacaagttaccttcaagtattctttctctatcgtcttttgagcttgaaaataaaaagcaatccgacaagttttagctgttaaaatggctcctgtagattggggaagtggtgtctgtgcttcagcttatgagtcatacatgaaaccaagtgtttctaagggaggcacgcccatgttgctgtggacccaattattctgctaggtcaaacatgcaaatctgcaggtaaaaacggtataggaaagtggggatgaagaggcaaggagcaagatctaccttgattaga

SEQ ID NO: 1454 - DNA, 500 bp, Homo sapiens; identical to SEQ ID NO: 1183

SEQ ID NO: 1455 - DNA, 500 bp, Homo sapiens
tacaatcctgaaagatacttgagaaactgtttaacaggcaactctaatttgaggttaccgctggatatttgagactgtaaaaaatatattaaccttaaaataccagagattaggtcaataactaaaatcatctcaacaaaatgtcgccttttatcagtaatgactgctgtgtggctgttaccaatgcacatactttcaagttagaggaaatggaaactgaaatcaaaagaaaacaaaaacctacaaagccggagaagtaagctaaggtagacatgattctccaggcagccttgctaagtaattgactagacattcgagaactattaaaaatacctgctctgtgcagaacagtgtgcaacggtgatgtggggacattttaaaatatggatgtgtaaggctcagttcctgtaggttcaggggtgagctctggcattcatatttttgaaaagctcccagatgattctgatgtgtgccagggttggtcaccagggtcacaatgc

SEQ ID NO: 1456 - DNA, 500 bp, Homo sapiens
attacaggtgtgagccacctcgcccggtcctatctctctttcttctctttctccctctcactttgtttctcttctctctctctctcccgcctccttcccccgtctcccctcccttccccccaccgccctcttcatagctgagcctgtccggcagtgcggcggatgtacggatgattcagtggctggcaggaagcccgccctgcccgcccgccagtgtcagtggtgttggcatcagcttgggcaggtgtgcgggctcaggatggggcggccgtggtgaggaaccctggactctcaggtaagcctttcccaggggtgcctcagtcctcaggctgtcccccatcccccaggagctcctggccccactgggtggggtgggaagaggcctggatgcctggcgccccctcccgcagccccactctcaccctggcaccaggctctgtggcacttcaggggtcagtttgtttctgggcttctggccactctcttgccctcgccttccc

SEQ ID NO: 1457 - DNA, 500 bp, Homo sapiens; identical to SEQ ID NO: 468

SEQ ID NO: 1458 - DNA, 500 bp, Homo sapiens
atctaaaactttccagaatttcagtgctttgtttccccctagcaattaagttcaatcaggcatgtgactgaccacacacattttatcagagggttaaagaacacattcagccatgttcttcaacaggtaagaaccaccctctgtttatcagctcaagaaaaagccagaagcaaacatacaaaattgtaacaagttaccttcaagtattctttctctatcgtcttttgagcttgaaaataaaaagcaatccgacaagttttagctgttaaaatggctcctgtagattggggaagtggtgtctgtgcttcagcttatgagtcatacatgaaaccaagtgtttctaagggaggcacgcccatgttgctgtggacccaattattctgctaggtcaaacatgcaaatctgcaggtaaaaacggtataggaaagtggggatgaagaggcaaggagcaagatctaccttgattagaccattactaagctcatattaattgccataat

SEQ ID NO: 1459 - DNA, 500 bp, Homo sapiens
cgctaatgggatggggggcttggagtggactctgaggctggggaaaggaggggtttggttttgcagatgctggacctgggtgtctctgagaggtccagacggaaaggcacgtggcgggtggatttaggaggctgcagttcatggagaggtccaggcagcagcaggtaccacttggagatgacaggtaacggatggtttctaaagccacaaacagggcgaggccccggggagagggcaggcctggagtcccgcgaggatccgtggttagaggcgccctcccacaccgcccacaggtctgcaaggtttgcacgcctccgctctgcaaggaagcaggtgcagttagttcccttggcctttcccagcacagggagacggcgcgtgtgacccggtgatctgttggggaggggaggggaggagcaggcagcacgggcgtttgggggctgctgggatggattttggggtgatgggaactgaggaaccaaaggtgctccatggtcttt

SEQ ID NO: 1460 - DNA, 500 bp, Homo sapiens
atgaattatactcttaatgacttttaaatattatgactagaagctacgtaataattatgatcaccttaatttgtaaatgacttatagtttcttggtgagggagaacattgcttaactatgttgaaaagagatctcctttcagtgaaactgttggtttgtgtggtattggaggcataaatatttgtagagaaattgttaatgtccctggaatgaggaactaaaagagagtcaaaaggaattgaaactcaacgagaagaaaaagaatttccttgggcatcccagcatgcttaagtgaggagcaggggatgccctgacttcaggttggagctacactgcttggtcccacttgggaaggagcagagaggagagctgtgaacatcatgtgcaatggctttactctttaccatctctgaagagggtagacctttgcttttctcttgaaagttttgatgtcatctattgttattagaccaggactttcattagaggtccatgtcagt

SEQ ID NO: 1461 - DNA, 500 bp, Homo sapiens
caatgaggcaagaaatttacagcttagcctgattaatgggccaggcagttaagagttctttgccaagctatgagcataatttatagtcatcacggcaggaggaaaggccacataactcacatccttaaagggcccttagaacaagagacacgccggatcattgaaaacgtctccactcctggcgccaaaagagatcggcacgtttctgggtattctggtcaaagaacagggagtctggattaatatacacggcagaaaaaagcgaagaaaagacacacaggtcatatatttctgactgatattccgtttgttgttttcggagggacttggtatttatttaaccacattctcacttgacacgccccctccccacaccttgtaaatgccttcctctttagccgagtcatttttcatcacatagaattgaaatgttgccaggaaggcggtttatgagattgtagaaatggcactagagaaagcagtgtgaaaagaggcctaga

SEQ ID NO: 1462 - DNA, 500 bp, Homo sapiens; identical to SEQ ID NO: 485

SEQ ID NO: 1463 - DNA, 500 bp, Homo sapiens
cattcagccatgttcttcaacaggtaagaaccaccctctgtttatcagctcaagaaaaagccagaagcaaacatacaaaattgtaacaagttaccttcaagtattctttctctatcgtcttttgagcttgaaaataaaaagcaatccgacaagttttagctgttaaaatggctcctgtagattggggaagtggtgtctgtgcttcagcttatgagtcatacatgaaaccaagtgtttctaagggaggcacgcccatgttgctgtggacccaattattctgctaggtcaaacatgcaaatctgcaggtaaaaacggtataggaaagtggggatgaagaggcaaggagcaagatctaccttgattagaccattactaagctcatattaattgccataatttaaaactaacaataaaatagagtaagaacctacaagggagcaaaattaaaaactatatattgttttaaaatataaaaatctcaatttttaaaagttgcttta

SEQ ID NO: 1464 - DNA, 500 bp, Homo sapiens; identical to SEQ ID NO: 1177

SEQ ID NO: 1465 - DNA, 500 bp, Homo sapiens
aactctgccagcgtgaggatataaatgtccttcttaatcaaagtaggaaaagcaaaggcctggcagctctaataaatcaaaaacaaaaaggaattcttgggaccctctgtcctgtcatgcaaacacaacccctcccacctcaggtttctcctcaatcattctggaccaataagtactttcatttgttgcttacagactcattactgtttttgctgcccaactatttccttttaggaagtttggtgtgtgcgtggttttgtaacctcacacaatagccacaatagcatgttataaatctcaaagtactttcacacagatcactttctttgaagatttcagtcctagcacccaatggaaacaaagacaaacaggaaagaccaacagtctgcaagggggctgaatctgctaaggattttaaatagttctgcaggctccacagagttggagaaatgaagacagaaatgctaagatttgttgattgactcgtccaaggttacaag

SEQ ID NO: 1466 - DNA, 500 bp, Homo sapiens
ggtacactggttggaggagctggggaagctacagcacccagaaaaatccatttgatgtgtggagggaaagttctgagttgacaacaaagagtgcccgttgccatgaaaaccacagtattaatttcagaaatgactgggtggagcctccaaagcacttcattcccctcccttcaacattctaggcttcccccacctttcaaaaggggaagtggcacatttggggcatgtgggcagctggtgggatgggtccgacccagtgagagcagcagctgtccagctccagctcaaagcagggcacgaaaaaaaggaaacaatataagtctttcttggaagaactttaaaggtttttaactttttaataagtgacttaagcagaagtgccaaaaaagctaagataaatagctgcttataaccagtatctactggtttatctacaaactaaccaagtctctctcagcccctcccattcacactccaggctctgtaaagattttatctga

SEQ ID NO: 1467 - DNA, 500 bp, Homo sapiens
attgggatgatgaggaaggagattcagggccgagggtgataccaggaggcagagcctgagtatcacctccttcccttctccaggaccgggtcccttttaggtgagactagatgaaaagggctcttcagcagctgacttcacagcaactaatttctgacaggtcagagttggcattgctcaaatctgggcttcatttccaagaagtttcacaagtctgccaggggaagtccctggacttcttgcttctttcgtgtaggacaggctgtcgaaacctcagtggataaaagacctagagaatgtgtatcccagaagaagctggccaaggatatgggagcaaccaccatggaccagaagtctctctgggcaggtgagcatggggttgataattcagcaggaaatttggtgaggaaggaagaggtaacaggtctgtagaagaagtaatcttcctcctttcctgggacttcagtctttccgttgaccttagtgtcaaaaaatttcaa

SEQ ID NO: 1468 - DNA, 500 bp, Homo sapiens
aggtctcctttcttgcctctggcagccttcctccttcctatactttctgccaactgctgaggcttccgtctcgaaacaaatgactcaaggtaaatcactggttggacttcccctttctcaaaatacaggaagtctgtgttgtttgcagtccctgtgggtgaacagtttcagctcagttacgaagtaggctgggccacatagaggactgggtcctgctggggcagggttccaggctactggggctggcaccgctgcatttttccttcctaagagtcatgtcagtgtgtctgtcaagtcaggcttgacgtcttaccccaaaaagcctgctgtactattatgaaatttagaaaaatgagcccaagagggaggggccctgtcaataattaataataacaactattatttcatgtttatggcacattaaccttcctaccaggcactgtgctaagtggctgacacgtgaacccatttgagccccgtaacagccctagtaataaggt

SEQ ID NO: 1469 - DNA, 500 bp, Homo sapiens
taactcctcgtctcttataacctctgtgcgtacacccagctgcccctcagagcagtcacatgaagtactagacatgccctctcactctcagggggtcagcccagtgccaggatctctggcgagggtcctccccttcccccattccacacagctgctatcccaccgtgggatttactgccaagggccgggggacatatccagctaccacagaaccaggaaacgggcacccctaacctcacctctgtgcaacggggcaaagcacaaatcattacagacaaaagtgggagctcattaatatctcccttcccaccaatggaggtacctgccactgtagcctgtcgacttctggatatcatttctacttcaaaacaagacccaggttttggcctagaatcccagaatcttagggttggaagattctgtcaaggtcatcccttccactgtgtccccaacagaataggtccagaaggcccatgtcatgatcagacatgttgttagca

SEQ ID NO: 1470 - DNA, 500 bp, Homo sapiens
ccgtgtcaacggcacgcctccaattgtgcatctcccttacctacagcttgttcaccagagccctgagcaggttgtttaccaggtcgggagtgttgactcagaagacagatgactttcagcacatgcaaaccgagtattgcaaaagctatcttccacccgtgttagtagctcacagttagtctccagcagccctgcgctccagctgcaaacatctcattagactaatgcattcagcacaggcagaaaactcgatttaccatagctacagcaatgaatttccattacgatgacagcttcaaccacatcatgtccggaaaaccagccaaccactggcttttaaagaacacacacattttacatgcagaaaacgaggcctctgtgtgtgtgtgtgtgtgtgtgtgtgtgtgtgtgtgtgtgtgtgtgtgtgtgtgttttgtgtttccttcctcttagcagcctaagagaaatgtgcagtgtagctttttgtcgacatgagctgc

SEQ ID NO: 1471 - DNA, 500 bp, Homo sapiens
tgcaatctcccatcaatgccccccaaataaacaatccgtccccaaagtggcacatttgctggtattcctcagattaaaatccctaaactaggtatttaatttggatttggcgtggccactatcggcctcagatagcgtcagaatcaaaataaaatttggaactcttatgagacaaccagcaactttctctgacgccggacttctctcacgctggtctttcttgcttctaacgatgggtctggaggcaatcgtcagtgatatttttgtggctgaggctggtttctggccgagtctgcctaattacgtgttggagtgcatgtcacacctgcttcctgagctcgcagaacacaggaatgcgctatgtaatatttatggttcctgttaaaacccacagaataatttacgacgcttggcactgggctgttgtcttcgacagaggctccctgccttggtagaaatgccccttcccctccacgcctaggtcaggaccagtacagagg

SEQ ID NO: 1472 - DNA, 500 bp, Homo sapiens
cgcatctgtcagatacggaacagagcaggaaccgaagcagggaacgcaggctcaagttatgccagagacaggccctttgcctcagactgtggcctcggtcaggaaaggaggcgcgagcgtgtggctggagaactctacaccaaacaccctggtttcctgagtggaaatcacactggctcaggaaaaggaagggggtgagaaggttggttggctggatggctgcttcaagtaatgcgaaaagtaaacccacgaaaccaccttttgaaaacaaagtgcgagggctgtgccatcctggctgcagcagggtcgtacctgcttccctaaccaatgtaccaccttttccagaaatagaacaaagacaaaagcggatgcataataaatcatttcagcctgccagcgctctgagagatgaaaaacctcgcccagagataggattgtgggtttacaaaaaaaccataaagcccaggcactctgccaagcccctagaacgctgccgggtc

SEQ ID NO: 1473 - DNA, 500 bp, Homo sapiens
cttggaaggtggagaggctggaagacagcctggtttatggagaaatttaactacagctgtggttaggtggttgacctggctttggcttgcttttaaatatgaacccttatgcacgtatttgaaaaataatgtctgcttgtttactttctttcttaaaggctgaaactgttacacacataaaccacaatcttaatcatctcatcctgtttctgcaaccaaggaagtcatcattcattgtgacatcatgttcggggaccaggcaaatagaggtgaggtcacaacataggaaagttgcttggtgtataattagtgtggggagcacaggggggtggattacaatgcacagacaaattctaatccatagcctgtaatttgagggttgggtcaatcataatttgggtgcaagcacacctacttccttttttaataagggagaatttagctcttgttacccacaagagttctcaaagtagaaaataataaaccatgttcttgaagcc

SEQ ID NO: 1474 - DNA, 500 bp, Homo sapiens; identical to SEQ ID NO: 269

SEQ ID NO: 1475 - DNA, 500 bp, Homo sapiens
ttctagacctccctttttcattttcttggtctctgaatgttgtgtttgtgttaccaatataacgatctgtggctgtattttatttgcacatctaacaactgattgttaagcttccgctatctggcaggcattgggtggggtttctctgagtcaagagtgaggaaaaaaagagggggagctcgtggacaggtaggacaggcggcagccaggatccaggctgtgcacggggaacattgaagaacgctgccacggccccgaagaagaagtggagccacggggagaggaacggggaatttagaggaagtggggcccgagggcagcggagcagagccgctagctcaaaaagcgcagtgctgaagtcacactgatgtcactgcagaagcccagaggagctaaggagaggtgagatgttgggggattccctagggcagctggagtgggcccctggccttttgtccggttggtggggaggaaagcattggaaagtataacttccagaa

SEQ ID NO: 1476 - DNA, 500 bp, Homo sapiens
cctttgctttttcttgtactggaatgcatatgcagtcacataacctccccagatggccacacttgaggagtaatggcctgtggctaacactgatctctaaaagaaagaggcatcttgtctacaaaaactttgcatctgcgttgctgaacggcgatttcacttcctccaaaaagaggcaagaaggaagtcccacatctgctttctttctctgtttgatcccgtgcaaccttctgacaccatctcattcagcgccaaaccgtgattcatatctgaggttcgcttctgtgtgggcttggaactaatccaggtgtttcctacttctgcatttcacctgtggtctaaaatggggaggaaagtctagttgcatttgctgggacaattccctttcagcaggaatctaggaaaccagtgtgaaaactgatggttaaataattactaagtagatcagagaactatggcttttaaagactttgcagtaaactttgttatggaaaatctgg

SEQ ID NO: 1477 - DNA, 500 bp, Homo sapiens
gaaaggtcctctggttacttaaatcccatttgccatagtttccttctccatggaagaaaaacatgcctaagttcatgtcaggacattcctgatttatccaagagcccaggatcaaataaacaaagggctctgagctctgccagggagcctcctccttcaggaggcagaactagagggaagtaggcttggtacagagctggcccatcaccccatgaacttggtgagtgacgtggctgctcactgccatggcgatggggatgttacgggtgggtggaagtgagagaagaggcaaataagtcatgagagacgaagcgaaagcgaggcagggtcacaggaggaacctacaaagccacagaatttgtacagaggccgactgtagtctatgaccgcagcaaaactaagctgagtccctgcaaagataagtccccatctcaggggtgcggcatgaaccaactatgactcgcaaaaacctatgacaacactacgttcagcaaggcttt

SEQ ID NO: 1478 - DNA, 500 bp, Homo sapiens
atgaattgcaacaaaccatgaggcttttggacttggggaggaggaagggagaggggaaagaacgaggctgtgagaatcatcagcactgagaatgatggagtgtatttctccgcaaccaattccaatccccaaatctctgttgtactggggagctctccaactaacagaggaaacgcagtcactgcccggcaccgtattaatgatttatacaccccgcaccactgcttttgttcacttgcggggcctggtcgtgttcataacggaatttcagggagtggggtcctgccttgccatgctgttttgctcagtgcagtgaagactgcttcataaatcaaaagaatttagtgctttacaaccttcctgagctctgagatggtgtgcgcctgtgtgcggttgtgtatgtgtgtgtgtttaatcagattcacttagacacattttcattgcctttctgtaaagaatgaatgaagaacgggatgcgatctgtcttaggtgtttcaggg

SEQ ID NO: 1479 - DNA, 500 bp, Homo sapiens
aatggcaaggtatatgcctgtctctcttcttccccaaatcacccctcagcctcccactccaccctgggaagacaatcaggtcctgtgccttgttttctaggcaatatttgggtcatttaataaggctcttttgcatccatcactataacctgaagcgaaaaatgtagctttggaaatggtgtttatagcaggcccatgggcaaaacgtttcaaccgggcaaaactgaagcaatcaccagattatggagccgtatttctgtttctttaaagacaaacatttttgtgtgtgtggctccacccagcctgagcttcctgactgagaggttttggtggcggtacagacacttttaactcacagtaaaagcaaaagcaacagctcaagcagcctccttggagaaaacctgaaaattcaacttgttcaagagaaggtgagcctggctgagaagagggtctggtgctattgggctgcgaagggcagtggggacagggtgtgtggctgg

SEQ ID NO: 1480 - DNA, 500 bp, Homo sapiens
cctattatatgcaaaacaagtaatatttaaagaaatatatctgattagttggcatcaaaaggcaaagatagaacaaggaagcatttgtgtgctgagcaagtggtaggcacaggaagtacttagctcagaggataaaagcattctgatgtgactgggataagacaaacattcagtgagtaagcaaaaacatgatttacattcaaaatttcctgcctactctttaactgttatttttattactctttgatgcggtcctttttatccaagaaaggcacttgctcttacactccctctcataatgacataagccttttctccgtgctattcatccacttgaatatctgcataagccaatcctcacttcccttcattctgccagaccttcttcaaaattcaggacaacatgcatccttttcaggaaacttcatatagaagtctgctggcactttcctcttgtatctcagggagagggcaacatctgcccctgtcatttacatctc

SEQ ID NO: 1481 - DNA, 500 bp, Homo sapiens
tcctgacctcaggtgatccacccacctcatcctcccagagtgctgggattacagacatgagccactgcaccggcttaataatgctatttctttagccatctccaaaggcagaaatattcacaatagcttcttaaccaaaaagcactcattgaaattcttattccttgatgagtcatgctttgcatgctgtttgaagtaagtacaacagacatgctcctagtgagaagtcagactcttacttagacttagcgaaagactctccctcctttcctgcctgccaattttgtgttgaaatattgactttggattgcaaatactatattgcggtgaacgaactttcaggcttattgtaaaacacagttcagaattttaggcacagaacggaaaggtcctgtggaggacctgctggccatgctttctgtgacagctattttttaacctaattttataagtgaaaaaacagaatgagagaatttaaattacctttttgatgccgtcta

SEQ ID NO: 1482 - DNA, 500 bp, Homo sapiens
gcccacccccagccccattgctcacggttcacccagtcccctggcctttccgacgctgtgcgcatctgtatttgttgcagtgaacagagcctagaattataggactttgtcagacagtttgattttcaaccccgtaaaaaatacattttacttaaccacctaggatacctctacattatagacctcaagcagaagtttcaggagacagtttcttactctcattagaggtgatgcgttttgtgtggtcttcggtttcattgccccataaactcacttggcgatctgcctgtgggtccccagcagtctgtaagccacagctttctcaaccgtacttcctgttctggaggagaaacctgagctgcaaagagctaagggtcttgctaaggtcataccagtgaattcaccaaacagccagtactggaaccctgtcctctgattcccatcctgtggcttttttaggcttgtgtaatcaattttaatgattgtaccattgtagctta

SEQ ID NO: 1483 - DNA, 500 bp, Homo sapiens
tttgagaagcaggcaagctgcacggcatagatactcaggcctggtgaaggcaaagtggggccacaccctagaaaaaccacaaaagtccccacagcctctgctttcactagtcagacctgtgggaaacttgtaagacacagtccatgtgatcggcgggtgggggcatgttgggaggggccttccgaaggccacagccaggctggcagggcagagtcctttccagaatttatctgtttgcttaaagcccagcggaggggccaccttcagtcaaccctccagcatactggtccaagtagttttttcaaagtgctttgtgagactttcaaaaggtacccatggggagggaagtgagaggaggaggaggggacggtgaagaaacagcttctttatttctagccttgcttgaatggcttcttgacggttactgctccagttttgctgagtcagaagaatcccacagccgctcaccggaaacacagctgttgggcaaaaataaccac

SEQ ID NO: 1484 - DNA, 500 bp, Homo sapiens
ttagatatcctcctttagtgtagtcacattcactgggtgaacactaaaagaaaaacgtgtcccaaaactcttttataatcctgtagctacagcaagattaaaatacacacacacacacacacacacacacacacacacacacattgaacaagtattacaggattgttaagaaaagaggaaggaaaattattcatccccagaatacagttaaagtagaagcaccttgacattttctaggatttaaaatgccgtttcttttctgttattctctccacttctggcaccatcctatagccctaaatatacagttctttgtatttacatagattccttctaacacagtgcagctgtccaggtgctatgtcttaaatgctcacaatatggctaagctgagggaaagaagattatgtcataacacacttgaactgttagaaacacgaaagaactgaaagtaatttaagctagaaaacatacatgtggttcagttcaagcttcattac

SEQ ID NO: 1485 - DNA, 20 bp, Artificial sequence
  Single strand DNA oligonucleotide
ctctggggacctgacccagc

SEQ ID NO: 1486 - DNA, 22 bp, Artificial sequence
  Single strand DNA oligonucleotide
actcaccctacaaatcctctac

SEQ ID NO: 1487 - DNA, 20 bp, Artificial sequence
  Single strand DNA oligonucleotide
tttgtagaggaatgggttgg

SEQ ID NO: 1488 - DNA, 25 bp, Artificial sequence
  Single strand DNA oligonucleotide
tccacacaaactaattattattaaa

SEQ ID NO: 1489 - DNA, 25 bp, Artificial sequence
  Single strand DNA oligonucleotide
agttgtgattatttttagtgtgtgt

SEQ ID NO: 1490 - DNA, 25 bp, Artificial sequence
  Single strand DNA oligonucleotide
atatcaaaatctaaaataaaaacca

SEQ ID NO: 1491 - DNA, 23 bp, Artificial sequence
  Single strand DNA oligonucleotide
gttggatgtgtttggtatattaa

SEQ ID NO: 1492 - DNA, 23 bp, Artificial sequence
  Single strand DNA oligonucleotide
aaaaaccaataataaccttaaaa

SEQ ID NO: 1493 - DNA, 24 bp, Artificial sequence
  Single strand DNA oligonucleotide
ttattttaaagatttgggtagttt

SEQ ID NO: 1494 - DNA, 22 bp, Artificial sequence
  Single strand DNA oligonucleotide
aaatcctttacaactccctaac

SEQ ID NO: 1495 - DNA, 23 bp, Artificial sequence
  Single strand DNA oligonucleotide
gtgtatttggttttttgaagatt

SEQ ID NO: 1496 - DNA, 24 bp, Artificial sequence
  Single strand DNA oligonucleotide
accaacaattaaataaaaacataa

---

What is claimed is:

1. A method for quantifying molecules of cell-free DNA having the methylation pattern of a cell- or tissue-type of interest in a sample derived from a subject, comprising:
   (a) identifying a DNA sequence of 50-200 bp that has at least four methylation sites, wherein the methylation pattern of said at least four methylation sites in the cell- or tissue-type of interest is different as compared to the methylation pattern of said at least four methylation sites in the same DNA sequence in a second different cell- or tissue-type, whereby the methylation pattern of said at least four methylation sites is characteristic of said cell- or tissue-type of interest, wherein a methylation pattern is the methylation status of each of said at least four methylation sites on a given DNA molecule;
   (b) amplifying said identified DNA sequence in the cell-free DNA of said sample to obtain amplified DNA molecules;
   (c) using deep sequencing to obtain the sequence of individual molecules of said amplified DNA molecules;
   (d) ascertaining from said sequenced amplified DNA molecules the methylation status of each of said at least four methylation sites per DNA molecule, thereby obtaining the methylation pattern of each of the individual DNA molecules of said sequenced amplified DNA molecules of said sample; and
   (e) quantifying the amount of amplified DNA molecules having the specific methylation pattern of DNA molecules of the cell- or tissue-type of interest that is present in the total of said amplified DNA molecules.

2. The method of claim 1, wherein said sample is derived from a subject having a disease.

3. The method of claim 1, wherein said sample is a body fluid selected from the group consisting of blood, plasma, serum, sperm, milk, urine, saliva and cerebral spinal fluid.

4. The method of claim 1, wherein said amplifying step (b) is conducted using primers that are methylation-independent.

5. The method of claim 1, further comprising contacting the DNA of the sample with bisulfite to convert demethylated cytosines of the DNA to uracils prior to said amplifying step (b).

6. The method of claim 1, wherein the sample comprises cell-free DNA which is derived from said second different cell- or tissue-type.

7. A method in accordance with claim 6, comprising repeating said step (e) using the second different cell- or tissue-type as the cell- or tissue-type of interest so as to quantify both the amount of amplified DNA molecules having the specific methylation pattern of DNA molecules of the cell- or tissue-type of interest and the amount of amplified DNA molecules having the specific methylation pattern of DNA molecules of the second different cell- or tissue-type in the total amplified DNA molecules.

8. The method of claim 7, further comprising determining the ratio of the amount of DNA molecules having the specific methylation pattern of said cell- or tissue-type of interest to the amount of DNA molecules having the specific methylation pattern of said second cell- or tissue-type.

9. The method of claim 6, wherein said step (e) quantifies the amount of amplified DNA molecules having the specific methylation pattern of DNA molecules of both the cell or tissue-type of interest and the second different cell- or tissue-type that are present in the total of said amplified DNA molecules.

10. The method of claim 1, further comprising, after said quantifying step (e), determining the ratio of the amount of cell-free DNA derived from said cell-or tissue-type of interest to the total amount of cell-free DNA in the amplified DNA molecules.

11. The method of claim 1, wherein said cell- or tissue-type of interest is selected from the group consisting of a pancreatic beta cell, a pancreatic exocrine cell, a hepatocyte, a brain cell, a lung cell, a uterus cell, a kidney cell, a breast cell, an adipocyte, a colon cell, a rectum cell, a cardiomyocyte, a skeletal muscle cell, a prostate cell and a thyroid cell.

12. The method of claim 1, wherein said cell- or tissue-type of interest is selected from the group consisting of pancreatic tissue, liver tissue, lung tissue, brain tissue, uterus tissue, renal tissue, breast tissue, fat, colon tissue, rectum tissue, heart tissue, skeletal muscle tissue, prostate tissue and thyroid tissue.

13. The method of claim 1, wherein the sample is a blood sample.

14. The method of claim 1, wherein said ascertaining step (d) is effected using a multiplex reaction.

15. The method of claim 1, wherein said cell- or tissue-type of interest is a non-diseased cell-type.

16. The method of claim 1, wherein said second different cell- or tissue-type is a hematopoietic cell.

17. The method of claim 1, wherein said DNA sequence of 50-200 bp has at least five methylation sites and said methylation pattern comprises the methylation status of each of the at least five methylation sites on a given DNA molecule.

18. The method of claim 1, wherein said DNA sequence is no longer than 170 bp.

19. The method of claim 1, wherein the amplified sequences in said amplifying step (b) are no larger than the size of said DNA sequence identified in step (a).

20. A method of detecting death of a cell- or tissue-type in a subject, comprising quantifying molecules of cell-free DNA of a cell- or tissue-type of interest in accordance with claim 1, wherein the cell- or tissue-type of interest is the one the death of which is being detected, and determining death of the cell- or tissue-type of interest in the subject when said quantifying step establishes the presence of said cell- or tissue-type of interest above background.

21. The method of claim 1, wherein, in said step (c), the sequences of at least 10,000 individual molecules are obtained.

22. A method of diagnosing whether a subject has a disease that is associated with the death of a specific cell- or tissue-type, comprising quantifying molecules of cell-free DNA of a cell- or tissue-type of interest in accordance with claim 1, wherein the cell- or tissue-type of interest is said specific cell- or tissue-type the death of which is associated with the disease being diagnosed, and determining that the subject has the disease when said quantifying step establishes the presence of a level of cell-free DNA of said specific cell- or tissue-type that is statistically significantly higher than the level of cell-free DNA of the same cell- or tissue-type in a sample obtained from a healthy subject.

23. A method of diagnosing whether a subject has a disease that is associated with the death of a specific cell- or tissue-type, comprising quantifying molecules of cell-free DNA of a cell- or tissue-type of interest in accordance with claim 1, wherein the cell- or tissue-type of interest is said specific cell- or tissue-type the death of which is associated with the disease being diagnosed, and determining that the subject has the disease when said quantifying step establishes the presence of a level of cell-free DNA of said specific cell- or tissue-type that is statistically significantly similar to the level of cell-free DNA of the same cell- or tissue-type in a sample obtained from a subject known to have the disease.

24. A method of determining the efficacy of a therapeutic agent or treatment of a disease that is associated with the death of a specific cell- or tissue-type, comprising:
   quantifying molecules of cell-free DNA of a cell- or tissue-type of interest in accordance with claim 1, wherein the cell-or tissue-type of interest is said specific cell- or tissue-type the death of which is associated with the disease and wherein the sample is one derived from said subject prior to administration of said therapeutic agent or treatment;
   repeating said quantifying step using a sample derived from said subject following administration of said therapeutic agent or treatment; and
   determining that the agent or treatment is therapeutic when said quantifying steps establish a decrease in the level of cell-free DNA of said specific cell- or tissue-type after administration of said therapeutic agent or treatment as compared with the level of cell-free DNA of said specific cell- or tissue-type before administration.

25. A method for quantifying molecules of cell-free DNA having the methylation pattern of a cell- or tissue-type of interest in a sample derived from a subject, comprising:
   (a) identifying a DNA sequence of 50-200 bp that has at least four methylation sites, wherein the methylation pattern of said at least four methylation sites in the cell- or tissue-type of interest is different as compared to the methylation pattern of said at least four methylation sites in the same DNA sequence in a second different cell- or tissue-type, whereby the methylation pattern of said at least four methylation sites is characteristic of said cell- or tissue-type of interest, wherein a methylation pattern is the methylation status of each of said at least four methylation sites on a given DNA molecule;
   (b) amplifying, with at least 15 cycles of polymerase chain reaction (PCR), said identified DNA sequence in the cell-free DNA of said sample to obtain amplified DNA molecules (c) using deep sequencing to obtain the sequence of individual molecules of said amplified DNA molecules; (d) ascertaining from said sequenced amplified DNA molecules the methylation status of each of said at least four methylation sites per DNA molecule, thereby obtaining the methylation pattern of each of the individual DNA molecules of said sequenced amplified DNA molecules of said sample; and (e) quantifying the amount of amplified DNA molecules having the specific methylation pattern of DNA molecules of the cell- or tissue-type of interest that is present in the total of said amplified DNA molecules.

26. The method of claim 25, wherein, in said step (c), the sequences of at least 10,000 individual molecules are obtained.

27. A method for quantifying molecules of cell-free DNA having the methylation pattern of a cell- or tissue-type of interest in a sample derived from a subject, comprising:
(a) identifying a DNA sequence of 100-250 bp that has at least four methylation sites, wherein the methylation pattern of said at least four methylation sites in the cell- or tissue-type of interest is different as compared to the methylation pattern of said at least four methylation sites in the same DNA sequence in a second different cell- or tissue-type, whereby the methylation pattern of said at least four methylation sites is characteristic of said cell- or tissue-type of interest, wherein a methylation pattern is the methylation status of each of said at least four methylation sites on a given DNA molecule;
(b) amplifying said identified DNA sequence in the cell-free DNA of said sample to obtain amplified DNA molecules;
(c) using deep sequencing to obtain the sequence of individual molecules of said amplified DNA molecules;
(d) ascertaining from said sequenced amplified DNA molecules the methylation status of each of said at least four methylation sites per DNA molecule, thereby obtaining the methylation pattern of each of the individual DNA molecules of said sequenced amplified DNA molecules of said sample; and
(e) quantifying the amount of amplified DNA molecules having the specific methylation pattern of DNA molecules of the cell- or tissue-type of interest that is present in the total of said amplified DNA molecules.

28. The method of claim 27, wherein the sample comprises cell-free DNA which is derived from said second different cell- or tissue-type.

29. The method of claim 27, wherein said DNA sequence of 100-250 bp has at least five methylation sites and said methylation pattern comprises the methylation status of each of the at least five methylation sites on a given DNA molecule.

30. A method of detecting death of a cell- or tissue-type in a subject, comprising quantifying molecules of cell-free DNA of a cell- or tissue-type of interest in accordance with claim 27, wherein the cell- or tissue-type of interest is the one the death of which is being detected, and determining death of the cell- or tissue-type of interest in the subject when said quantifying step establishes the presence of said cell- or tissue-type of interest above background.

31. A method of diagnosing whether a subject has a disease that is associated with the death of a specific cell- or tissue-type, comprising quantifying molecules of cell-free DNA of a cell- or tissue-type of interest in accordance with claim 27, wherein the cell- or tissue-type of interest is said specific cell- or tissue-type the death of which is associated with the disease being diagnosed, and determining that the subject has the disease when said quantifying step establishes the presence of a level of cell-free DNA of said specific cell- or tissue-type that is statistically significantly higher than the level of cell-free DNA of the same cell- or tissue-type in a sample obtained from a healthy subject.

32. A method of determining the efficacy of a therapeutic agent or treatment of a disease that is associated with the death of a specific cell- or tissue-type, comprising:
quantifying molecules of cell-free DNA of a cell- or tissue-type of interest in accordance with claim 27, wherein the cell-or tissue-type of interest is said specific cell- or tissue-type the death of which is associated with the disease and wherein the sample is one derived from said subject prior to administration of said therapeutic agent or treatment;
repeating said quantifying step using a sample derived from said subject following administration of said therapeutic agent or treatment; and
determining that the agent or treatment is therapeutic when said quantifying steps establish a decrease in the level of cell-free DNA of said specific cell- or tissue-type after administration of said therapeutic agent or treatment as compared with the level of cell-free DNA of said specific cell- or tissue-type before administration.

* * * * *